United States Patent 11,098,302 (IDENTIFICATION OF POLYNUCLEOTIDES ASSOCIATED WITH A SAMPLE) - sequence listing, part 50

SEQ ID NO: 170429 - DNA, 805 bp, Homo sapiens
  misc_feature: GYAE6OF02FFQG4.47.77.G11.1.454.CMB.1.raw
  modified_base (288)..(288): a, c, t, g, unknown or other
  misc_feature (288)..(288): n is a, c, g, or t
tcagagctcacgtacacgaccggtgctcgatttagctagtcactcaagggaaggggagctctgagagaggagcccagccctgggattttcaggtgtttcatttggtgatcaggactgaacagagagaactcaccatggagttgggctgagctgggttttcctgttgctctttaaaaggtgtccagtgtgaggtgcaggtagtggagtccgggggagcttagtcagccgtggggagtccctgagctctccgtgtgtagtctcgtggaatctagtttcagtacctttcgnggatgcacgtcggtcccgacaaaccgtccgagggttaacgggcctagggtggttcgggtcctacgacggttactacaacttcctggtaacgtcgggacttagggtttacgttaaacgttaaaagtttacgtacgggtaccgggtaaccgttaccggggtagggaaccggggggtaccctaacgtttaccgaacgggttaacttccggtaacccgtaagggaaacggtaaccgaaccgggacgtaaaggtacgttaacgttacgttaggttaactaccggttaagggtaaaacttacgtaaactaacgttaccgtaggaacggtacggtaaccggtaacggtaacgtttaacgggacctttacggtaccgttaactcgtttacggttacggttttacggttttaaccggaccggttcccggtttaaccccgggtttcccgggtaccccggggttaccgggttaccgtttacccggggtaccgggggtaccccgttaaccggggtaacccccggttggg

SEQ ID NO: 170430 - DNA, 504 bp, Homo sapiens
  misc_feature: GYAE6OF02G681V.47.77.G11.1.454.CMB.1.raw
  modified_base (458)..(458): a, c, t, g, unknown or other
  misc_feature (458)..(458): n is a, c, g, or t
  modified_base (460)..(461): a, c, t, g, unknown or other
  misc_feature (460)..(461): n is a, c, g, or t
  modified_base (463)..(464): a, c, t, g, unknown or other
  misc_feature (463)..(464): n is a, c, g, or t
  modified_base (466)..(467): a, c, t, g, unknown or other
  misc_feature (466)..(467): n is a, c, g, or t
  modified_base (469)..(504): a, c, t, g, unknown or other
  misc_feature (469)..(504): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatggggatgggtggctacgactcgttgggggcccgggaacctggtcaccgtctcttcacgtcttaccaccgaagggcccagtcggtccttcccccgtggcccgtccctcgctccgaggtacgcctaccgtcggtcgggggcacgacggccgggcccgtggggcctcggcctggtaccgaacggtacttacttccgtacgtcgacgtctcgtcgaggcgggctggacacgggcgcatagncnncnngnngnnnnnnnnnnnnnnnnnnnnnnnnnnnnnnnnnnnn

SEQ ID NO: 170431 - DNA, 749 bp, Homo sapiens
  misc_feature: GYAE6OF02H8SMK.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttgtggcttaattttaaaaagtgtccagtgtgaggtgcagctggtggagtcgtgggggagtcttagtacagccgtggggggtccctggagactctcctgcgcacgcctctggtacttctccttttagtagttatcgccatggtagttcggtcccgccaggcctcgagggagggtctgggaggtcgggtctcgaggctaggttgggtggttaggtgggtcgaccgaagggaacctacgtaagtttaaaccggtaaacgtcccctaggaccgaacgggggacccttaacgtttacttttacgtccgtacccgtaaaggtaacgaacgtaaacttacccgaaagggtaaaccctaagttaaccgttaacggtaacttttaccgtacgtaccgtaacgtttacgaacccgtaaagtaccgtaggacggtaagtaccgggaaggaaccgtaccgggtaccgttaagttattaacgtttaggttacgtttaaaggtggggtaattacggggtcggtaaccggtaaccggtcgttaaccgggttccggggggaaccccgggtacccggttacggggtaccctaaccccggg

SEQ ID NO: 170432 - DNA, 876 bp, Homo sapiens
  misc_feature: GYAE6OF02JQABT.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggtagtttgggctgacctggtctttttcttgtggacttatttaaaagtgtcagtgtgagtgcagctggtggagtcggtgggggaggcgttagtacgaggccggttcggggggtcccgtggacgtaccttccgtccgttggccgacgacgtccctcgtggtacttcttacccgttttagttacgtttattcgacctattcggtacggtttcgggtaccccggtcccgaggtcccgttacccggaagggggtaacgggggtccgtaggggtagggtcggggttccgtaccgtgggaccgttaggttggggtgggttaggtcgggtacggacccggtaaggaccgtaacgttaacggttaaaccggtaaaccggttcccgtcggtaacggtaccggttaccggttagttttcgtttaccttaccgtaccgaaggtaacgaacccgttaaagttcccggtaaaggaaaccttaaagttcccgttaagttacgtttccgttacgtccgttaaggttaccggaaacccgtaggtaacgttaacggaacggtaacggggtacggtaaaccggggtaccgtaacccggggttaaccgttaaggtttacgtttaagtttacgggttaagttaaagggttcggggttaacggttcgggggttaacggtccggttaaaccggtacggtttccggggttacccgggggggacccgggttaaccccgggtttcggtcccggttaaccccgg

SEQ ID NO: 170433 - DNA, 526 bp, Homo sapiens
  misc_feature: GYAE6OF02I64ET.47.77.G11.1.454.CMB.1.raw
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(491): a, c, t, g, unknown or other
  misc_feature (486)..(491): n is a, c, g, or t
  modified_base (493)..(493): a, c, t, g, unknown or other
  misc_feature (493)..(493): n is a, c, g, or t
  modified_base (495)..(499): a, c, t, g, unknown or other
  misc_feature (495)..(499): n is a, c, g, or t
  modified_base (501)..(503): a, c, t, g, unknown or other
  misc_feature (501)..(503): n is a, c, g, or t
  modified_base (505)..(515): a, c, t, g, unknown or other
  misc_feature (505)..(515): n is a, c, g, or t
  modified_base (517)..(526): a, c, t, g, unknown or other
  misc_feature (517)..(526): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaaagtgggattgggtgggcttaacgacttcgttcgggggccgggtaacccctggtccaccgttcttcttcagcttccacaaggcccatcggtccttcccccgtggccgtccctgcctccgaggacgccacctcgtggggcacgacggcgcctgggctcggcctggtcaacgggacttaccttccgaacggttcgaagtccgttcgtggacgggccgggtcttacgggaccaacgggccgtacgaacgttagcgtagcgatcangnngnnnnnngngnnnnngnnngnnnnnnnnnnngnnnnnnnnnn

SEQ ID NO: 170434 - DNA, 443 bp, Homo sapiens
  misc_feature: GYAE6OF02FWSM1.47.77.G11.1.454.CMB.1.raw
  modified_base (313)..(313): a, c, t, g, unknown or other
  misc_feature (313)..(313): n is a, c, g, or t
  modified_base (423)..(443): a, c, t, g, unknown or other
  misc_feature (423)..(443): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatgggtggctacggactcgttgggggccgggaaccctggtcaccgtctcttcagcttccaccaagggcccatcggtcttccccctggcnccctgctccaggcgcacctcgtgggggcacgagcggccctggggctgcctggtcaaggtctacttcctacgtgacgctcgtgacggcgggctggcgaaggcgacagtagnnnnnnnnnnnnnnnnnnnnn

SEQ ID NO: 170435 - DNA, 854 bp, Homo sapiens
  misc_feature: GYAE6OF02G4MVF.47.77.G11.1.454.CMB.1.raw
tcagagctcacgtacacgaccggtgctcgatttagctagtcactcaaagggaaaggggagctctgagagaggagcccagccctgggattttcaggttgttttcatttggtgatcaggactgaacagagataactcaccatggagtttggctgacctggtctttttctgtggcttaatttaaaagtgtccagtgtgagtgcgagcgtggtggagtcggtgggggagtcttaagtacgacggtccggtcgggggtccctggacgaccgttcctcgtggcgcgcgtcctgtgtacgtttcttacgtttagtagttacgtcgtactacgttacgtacggttccgggtcccgaccggtacggtacccggtacgggtaacggggggaacgggtacggttagggtacgggttcgggtacgtaccgtacgggtcggtaagggtttcggggttagggttaggttcgggtccggaaccgggacggtaaaccgtaaaccgttaacggttttaaaccggtaaaccccggttcccggtacgggtaccgggtaacccggggttaaccgttacgtttttaaccgttacgttaacccgtccggtaaagacccgtaaacgttaaccgttaacggaacggtaaactacgttacgtcgttaacgttcgacgttacgtaacgtacggaacctaaggtaacgtcggtaagtacgggtccggaacggtaccgtaaccggtactttaaggttaagtttaaccgtttagttaacggtttaacgggtagggttacgttcgggttaaccggtacgttacggtaccggttacgggggttcccgggggtaacccgggtaccgttccggggaccttacccggg

SEQ ID NO: 170436 - DNA, 479 bp, Homo sapiens
  misc_feature: GYAE6OF02J1NTJ.47.77.G11.1.454.CMB.1.raw
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (458)..(479): a, c, t, g, unknown or other
  misc_feature (458)..(479): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggcctatattattgtgttaaatgggatggtggctacgactcttgggggccggggaaccctgggccaccgtctcttcagcttccaccaagggcccatcggtcttccccccnggtccnccctgacctccaggnccacctcgtgggggccacgacggccggcccctggggcctgacccgtgggtccaaagggtacctcctttccgacggtgacggctcgtgggaacggtccggggaccttgggaccaacgggcgcgaactaggnnnnnnnnnnnnnnnnnnnnnn

SEQ ID NO: 170437 - DNA, 639 bp, Homo sapiens
  misc_feature: GYAE6OF02I7RIR.47.77.G11.1.454.CMB.1.raw
  modified_base (199)..(199): a, c, t, g, unknown or other
  misc_feature (199)..(199): n is a, c, g, or t
  modified_base (481)..(481): a, c, t, g, unknown or other
  misc_feature (481)..(481): n is a, c, g, or t
tcagagctcacgtacacgaccggtgctcgatttagctagtcactcaagggaaaggggagctctgagagaggagcccagccctgggattttcaggtgtttcatttggtgatcaggactgaacagagagaactcaccatggagtttgggctgacctggtcttttcttgtggtctattttaaaagtgtccagtgtgaggtgnagctggtggagtcgtgggggaggtcttaggtacagccgtgggggtccctgagactctcctgcgcacgcctctggtattctcctttagtattatcgcctatgtacgttcgggtccgccaggccgtccggaggggaaggggcgtgggtaggtcgggtctcgaggctagttgggtggtaggtggtgccgaggactacgacgttaacgtaaagtccctaggccgacgggcccgtattccttttatccgtaccagacacgtaattccaaggtaaccatactgtactntagctagtaccacgaacgtaccgtgaacgacggtcggaaggtaccgacggtccgttaatactttagttagtaaggttaagtagggtagtgggtacgtaccgtacgtacggttcgggttacgggggtacccgggtacccggttcgggttacctacccgg

SEQ ID NO: 170438 - DNA, 801 bp, Homo sapiens
  misc_feature: GYAE6OF02JDAN6.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttggctgtacctggtcttttcttgtggctattttaaaaagtgtccagtgtgaggtgcagcgtggtggagtcgtgggggagcttagtacagccgtgggggtccctgagctctcctgcgcacgcctcgtggtattccttaccgtttagtagttactcgacctatggtacgttcgggtcccgcgacggccgtaccgaaggggtaacggggtcgttagggacggtttggggtccttacggtacggtcgttagtttggggttaggttgggttacgggtcgaccgtaaggtaccgaacgttaacgtttaaccggttaaacgttccccgtagaccggaccgggtccgtacttttaccgtttaacctccgtaaccgaggtaaaccgtaacttaaacgtttaccgaaacgggtaactaccgtaacgttagttacttcgttacggaacttaggttaccggaaccgttaaggtacgttacggaggtaaccggtaggaaccggtaaccgtaacccgggttaacctttaagttaaacgtttacggttttaggtaaacggtttaaacgggtggggttaacttcggggtaacggttacccgtacggtttaaccgggttccggggtacccggggggttaaccccggtaaccggttccgggtacccttaacccgg

SEQ ID NO: 170439 - DNA, 773 bp, Homo sapiens
  misc_feature: GYAE6OF02I9737.47.77.G11.1.454.CMB.1.raw
  modified_base (304)..(304): a, c, t, g, unknown or other
  misc_feature (304)..(304): n is a, c, g, or t
tcagagctcacgtacacgaccggtgctcgatttagctagtcactcaagggaaaggggagctctgagagaggagcccagcccctgggattttcaggtgttttcatttggtgatcaggactgaaccgagagaactcaccatggagtttggctgagctggctcgtttcttgtggtctttttaaaaggtgtccagtgtgagtgcaacgtgttggagttcgtaggggactacttagtaccgaccgtgggggtccctgacgactctcctgtgcagcctcgtaggtcctcgtaccgtttacgctaacgtcngtactagtacggggccttcggggtccccgtcgaacgggccgtaccgggggaagggtctcgggaggttcgggtcctacgtaagttagttggtactaggagtaagtggtaaggaacgcgtacgttaacgtttcggtaacgggttcggtaaaccgtccgggttacgggtaaaccggggtcccgggttttaaccaaccgtaacggttccccgtaaccggtaacggaacggttaaccgttaaacgtttacccggaagggtacggacctaccggtacgttaaggtaccttaccgtaaacgtaaagtacggaaaccgtacggtaccctacgggaagaccggtaccggacggtaaccgaaccggttcgttactttacgttaccgagtcggaaccttaacggtccttaacgtaccgaaccgttacggccccgttaccccgtacgtcccgtattacccgtttaggttacgttaccccgg

SEQ ID NO: 170440 - DNA, 425 bp, Homo sapiens
  misc_feature: GYAE6OF02FKB6A.47.77.G11.1.454.CMB.1.raw
  modified_base (134)..(134): a, c, t, g, unknown or other
  misc_feature (134)..(134): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (417)..(425): a, c, t, g, unknown or other
  misc_feature (417)..(425): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttanctccagagacaattccaggaacatactgattctgcagttgaccagactgagagtcgaggacacggccgtatattattgtgttaaatgggatggtggctacgactcgttggggccggggtaaccctgggtccaccgtctcttcagcttccaccaagggcccatcggtccttccccctggccnccctgcctccaggcgcacctcgtggggcacagccggcctggggctcgcctggtcaaggactacttcctacgtgctctgacgcgggtctggcgagcgngatgnnnnnnnnn

SEQ ID NO: 170441 - DNA, 762 bp, Homo sapiens
  misc_feature: GYAE6OF02IEBRJ.47.77.G11.1.454.CMB.1.raw
  modified_base (203)..(203): a, c, t, g, unknown or other
  misc_feature (203)..(203): n is a, c, g, or t
tcagagctcacgtacacgaccggtgctcgatttagctagtcactcaagggaaaggggagctctgagagaggagccaagccctgggattttcaggtgttttcatttggtgatcaggactgaacagagagaactcaccatggtagtttgggctgacctggtctttttcttgtgtcttaattttaaaaagtgtccagtgtgaggtncagcgtggtggagtcggtggggagtcttagtacgagtcccggtgggggtaccctgacgtcctctccgtgcgcacgtcctcgtggtactttcttaccgtttaagttagttagtcgacctagttacggtaccgtttcggggtccccgacccgtaacggtccgtaccggtaacgggggaacgggtcgtacgggtgggtcgggttctacggtaggtacgtaggtttgggtaggtagtcggtacgtaccgaagggacctaaacgtaacgtttaaaccgtaaaccggttcccaggtaccgaacgggtacccttattttacctttagtccctaaccgaaggtaacgtaaactaacttaccgaacggtaaacaagttactagtacgttacgtcgtaccgtaagttacaaacgtagtacgtggaacgtacgtcggaacgacgtaccgtacgttaattaagtttacttacgtaaggtttaaagtcgggtaagttacggtcggttaaacctcggtaccggtttaccgggtacccggggggaccgtaaccccggttggacccccgttacgg

SEQ ID NO: 170442 - DNA, 778 bp, Homo sapiens
  misc_feature: GYAE6OF02HGWXJ.47.77.G11.1.454.CMB.1.raw
  modified_base (214)..(214): a, c, t, g, unknown or other
  misc_feature (214)..(214): n is a, c, g, or t
  modified_base (414)..(414): a, c, t, g, unknown or other
  misc_feature (414)..(414): n is a, c, g, or t
  modified_base (674)..(674): a, c, t, g, unknown or other
  misc_feature (674)..(674): n is a, c, g, or t
tcagagctcacgtacacgaccggtgctcgatttagctagtcactcaagggaaaggggagctctgagagaggagcccagcccctgggattttcaggtgttttcatttggtgatcaggactgaacagagagaactcaccatggaggtttgggctgacctggtctttttcttgtggctagttttaaaaagtgtccagtgtgaggtgcagctggtggngtcgtgggggagcttagtacaggccgttcggggggtccctggacgtacctcctccgtcgtcgcacgccctgtggtactttccttccgtttaagttagttactcgcctagtgtacgttgggtccccgccgtacggtcctccggaaggggtacgggacgtgggaggttcggtcgtagacggctaggtttgggtggttacggngggttacgccgtaggacacgtaacgttaacggtaaaccgtcccgtaggaccgacgggtccgtacgtttacttttacgacttcccgagtaacgactaaacgttcccaaagggtaacctaaacttaccggtgttaccttacttcggcgttacgtacccgtaaccgaagtacgttaccggaagggccgtttaaccgggaggaacccggaacccgggtaccctttaaagtttattttaaccgttgggttaaagtttttaagggnggggtttacgtagggggttacctacccgtttccggtaacccgggtttcgggggtaaccccgggggttaaccccgggtaccccgttttcggtaccccgttacccg

SEQ ID NO: 170443 - DNA, 732 bp, Homo sapiens
  misc_feature: GYAE6OF02FXUKJ.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggctttttctgtggctattttaaaagtgtccagtgtgaggtgcagctggtggagtcgtgggggaggcttagtacagccgtggggggtccctgagactctcctgcgcagcctcgtggtattctcctttagtagttatgccatgacgttcgggtccgccgaggcctaccgaggggaaggggcgtgggaggtgggtctcgaggctagttgggtggtaggtggtgccgaggacactaagttaacgtaaacgtcccgtaggccgacggggcctagtttactttaacgtcctacccgaagaacgtaactaacgttacccgaagggtaaacctacgttacctaggttaaccttcgttacgtaccgtaagttcggaaacctaacggtaccgtagggaacggtacgggtaccggaacgggtaacccgaaccgggttaccgttaaagtttaagttttacggtttagttaacgggtttaaaaggtcgggggtaagtttacggggtaccggttaccgttaacggtaccgtttacggggttaccggggggacccccggggttaacccgttccgggtacccgttaccccgg

SEQ ID NO: 170444 - DNA, 839 bp, Homo sapiens
  misc_feature: GYAE6OF02IKFKS.47.77.G11.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
tcagagctcacgtacacgaccggtgctcgatttagctagtcactcaagggaaaggggagctctgagagaggagcccagccctgggattttcaggttgttttctatttggtgatcaggactgaacagagagaactcaccatggagtttgggctgacctggtcttttctgtggtcttaatttaaaagtgtccagtgtgaggtgcagctggngtagtcgtggggagtcttagacgnggtccgtggggtacgtcccgtagacgtacgttccgtccgtgttacgtagttcctacgtacggtaattcgtaagtttcgacgttaccgttcgtaggtatcgtaccgtacgttccgggtaccccgaaccgtaaacgtcccggtaaggggtaagggttccgtaggggtcggttcgggtacgttacgtaccggttagtaccaaacgttcgacgtagtggtacctaggttagttaaagttaagttagtaccgtacgtaccgttaccgggacgggtacgggtcccgtaagttaccgacgtacgtaactccggtaacgaacgtaaacgaacgtaaccggtaatacggtaagttaaccgttagtaagttacgtaacgtaaggaaacttaacgggaaactacgtacgtaacgggacggtaaaccgtacgggtaaaccgtacgttaacccggtgtttcccgttaattaacccggtttccgttaagggtttttacggtttaccgggttttaccggttaacgtttcccgggttaaccccgggttttccccggggttaaaccggggtaccccgggtttttaacgttccccggggggtacccgggttaaaacccccgggg

SEQ ID NO: 170445 - DNA, 595 bp, Homo sapiens
  misc_feature: GYAE6OF02INFX3.47.77.G11.1.454.CMB.1.raw
  modified_base (531)..(531): a, c, t, g, unknown or other
  misc_feature (531)..(531): n is a, c, g, or t
  modified_base (555)..(555): a, c, t, g, unknown or other
  misc_feature (555)..(555): n is a, c, g, or t
  modified_base (564)..(595): a, c, t, g, unknown or other
  misc_feature (564)..(595): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggccgtaatattattggtagtttaaaagtgggatgggtggcttaacgacgttcgttcggggggcccggggtaacccttggtcctaccgttcttcttccgaggtcctttaccgaaccgaacggggtcccccaacgttccgggttccccttttcccccccgtcggggtccccgtcccccgtttagcccgttaccccggaaggggtaaccgcccgtaaccccgttcggggttacggggggccctaaccgacgggtccccggggtaccccgtgggggtcctcggtcccggtggtaacccgaaagggttccttactttaccggtacgtgacgtctcgnggacggtccggagtggacgacggngactgtagnnnnnnnnnnnnnnnnnnnnnnnnnnnnnnnn

SEQ ID NO: 170446 - DNA, 792 bp, Homo sapiens
  misc_feature: GYAE6OF02GD8CZ.47.77.G11.1.454.CMB.1.raw
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatcggagtttgggctgacctggctttttcttgtggctattttaaaaagtgtccagtgtgagtgcagctggtggagtcgtgggggaggcgttagtacagtccgtgggggtccctgagactctcctgcncgagccgtntggtattccgttctttagttagttatcgacctatgtacgttcgggtaccgtccgaggtccgtcccgaaggggaacgggcgttagggacggttagggtcctcgacggtacgtagtttcggtgggttagtgggtacgccgaggacgtacgtactttaaacgtaaacggtccccgttagaccggtaaggggtaccctaagtttaccttttaatcccgttaccggaacggtaacgtaacctaacgttacccgaaagggtaaaactacgttaaccgttacggtatttcccgttaagccgttaacggttcgaaacctggtaaccgtagtaacgtaccggtacgaacgggaacccgaccgggttacttaaacgtttactttaaggttacgtttaacgttaaaagggttccgggggaaagtttcggggttacggtaaaccggtttaaccggtaccggttttacccgggttttacggggggggacccccgggtttaaaccgttcccgggggttacccttaacccccggg

SEQ ID NO: 170447 - DNA, 547 bp, Homo sapiens
  misc_feature: GYAE6OF02H9X8H.47.77.G11.1.454.CMB.1.raw
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(508): a, c, t, g, unknown or other
  misc_feature (506)..(508): n is a, c, g, or t
  modified_base (511)..(517): a, c, t, g, unknown or other
  misc_feature (511)..(517): n is a, c, g, or t
  modified_base (519)..(532): a, c, t, g, unknown or other
  misc_feature (519)..(532): n is a, c, g, or t
  modified_base (534)..(547): a, c, t, g, unknown or other
  misc_feature (534)..(547): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctcagagacaattccaggaacatactgattctgcagttgaccagactgagagtcggaggacacggccgtatattattgtagttaaagtgggatgggtgctagactcgttgggggccgggaaccctggtccacgtctcttcagcttccaccgaacggcccagtcggttccttcccccgtggccgccctcgccgtccgagggacgccaccgttcggcgggggcctaacgacggccgggtcccgtggggcctcggccgtacggtcgaacgggtaccttccgttacccttacggtcggaacgtccgttcgttggaccgggtcggggccgtttacggggaccgaacggggtcgtaccgtaaagttgngctgngngcnnncgnnnnnnncnnnnnnnnnnnnnngnnnnnnnnnnnnnn

SEQ ID NO: 170448 - DNA, 777 bp, Homo sapiens
  misc_feature: GYAE6OF02JKS1C.47.77.G11.1.454.CMB.1.raw
tcagagctcacgtacacgaccggtgctcgatttagctagtcactcaagggaaaggggctgagagaggagcccagccctgggattttccaggtgttttcatttggtgatcaggactgaacagagagaactcaccatggagtttgggctgacctggctttttcttgtggctagttttaaaaagtgtccagtgtgaggtgcagctgggtggagttcgtgggggagcgttagtacaggccgttggggtcccgtgaggactcctctcgcgcagcctacgtggtcttacgtcccgtttagttagttattcgccagttcgtagttcggggtccgcccgtaaggtccgtcggtaagggacggggtccttaggtacggttcgggtcgttccgaggaccttaggttacggttgggttaagtcggtggaccctagggaacctactagtttaaccgaacggtccgtcggaccgagggtcccgtaatttccgtttaactcgtacctagtaacggctaagttacgaacggtaacaacttactaaccggtactttacgtgtacgttacgttcgaaccgtaaacgaacctgggaacgtaaccgttcggggaactaaccggtaccggttaccgtaaagtttaccgtttaagtagggtttaacgttacgttacggggtacgttaacgggttgtaaaccggtaacccggtttccggtaaaccgggtttccgggggtaaccccggtttaacccggggtaacccgtttccgggttaaacccggtcccgtttaaaccgg

SEQ ID NO: 170449 - DNA, 773 bp, Homo sapiens
  misc_feature: GYAE6OF02JHXIN.47.77.G11.1.454.CMB.1.raw
  modified_base (728)..(728): a, c, t, g, unknown or other
  misc_feature (728)..(728): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagaataactcaccatggagtttggctgaccgtggtctttttctgtggtacttaattttaaaagtgtccagtgtgaggtgcagcgtggtggagtcggtgggggagtcgttagtacgacggtccggtcgggggtccctggacgtaccttccgtccgtaggtcgaccacgtccttcgtcggtacctttacctaccttactaaattaatttacgtacgtacttaagtcggtaccgtaagggttccgggtaccctacccggtaacggtcccgttaaccgacgggtaacggaaccggggtaacgtaagggtacgggttacggggttggggtaccggtaacgttacgttaccgttccggtaccgtaaggtacggaaacttacgttacctttagtaaacgttacgtaaccgacgaacgtaccctccggtacgggccgggacgttaacttccgaaacctcgttacgaccgtaacggaactaaaccgtaacctttaccgaaacgaacgttaaccggttaactccgtagtaccgaccgtaactaccgaccgtaacgtcgtaacgtaaacgaccgtaacgaaccgacgttcctacccgtacttaccgtaaccgttntacggtcgaaggttacgagttacggtcgaacttagtacagttacg

SEQ ID NO: 170450 - DNA, 815 bp, Homo sapiens
  misc_feature: GYAE6OF02IV8F6.47.77.G11.1.454.CMB.1.raw
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttggggccgggaacctggtcaccggtctcgttcagtccttaccgaaccgaaacgggcccctaagtcccgggtacccctttccccccgtgggtcccgtccccgttggcccttacccggaaggggtacgtcccgtaaccccgttcggtacgggggggaccctaacggacgggtcccggtccccggtagggggtcccttcgggacccgttagggtaaccgaaacggggtacctttaacccgtttaccccgttaacgggtcggtaacgtccgtttaccgtacggggtaaacgggtccccggggggtactttacgggggaacccggtaaacggggtacccggtaaccggtaaagttaacgggacgtacgtacggaaccgtacgtacgtacgacgtacgtacgtacgtaccgtacgtacgtacgtacgtacgtacgtacgtaacgtaacgtaccgtacgtaacgtaacgtacgtacggtacgtaccgaacggtacggttaaccggtacgtaccggtaccggtaccggtacgtaccggttaccggttaccgtaacggttaccggtacccggtaacgtaccg

SEQ ID NO: 170451 - DNA, 535 bp, Homo sapiens
  misc_feature: GYAE6OF02JZ5F9.47.77.G11.1.454.CMB.1.raw
  modified_base (341)..(341): a, c, t, g, unknown or other
  misc_feature (341)..(341): n is a, c, g, or t
  modified_base (497)..(535): a, c, t, g, unknown or other
  misc_feature (497)..(535): n is a, c, g, or t
tcagagctcacgtacacgaccggtgctcgatttagctagtcactcaagggaaagggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaagtgggatgggtgctacgactgttcgggggaccgggaaccctggtccacgtctcttcagtcttaccgacgaacgggcccagtccggtccttcccccgtggccgtccctcgcctccgaggcnccgacctcggtcggggcacgacgccggcccgtgggctcgtaccgtggtaccgaacggtaccttaccgtttccgtacggtgtaccgtcgttccgtaggacgggtccggggtcgttacgggaccgaacggggtccgacgtaagtaggcagtcgatcgnnnnnnnnnnnnnnnnnnnnnnnnnnnnnnnnnnnnnnn

SEQ ID NO: 170452 - DNA, 747 bp, Homo sapiens
  misc_feature: GYAE6OF02JN9I7.47.77.G11.1.454.CMB.1.raw
  modified_base (190)..(190): a, c, t, g, unknown or other
  misc_feature (190)..(190): n is a, c, g, or t
  modified_base (486)..(486): a, c, t, g, unknown or other
  misc_feature (486)..(486): n is a, c, g, or t
tcagagctcacgtacacgaccggtgctcgatttagctagtcactcaagggaaaggggcgtgagagaggagcccagcctgggatttcaggtgtttcatttggtgatcaggactgaacagagagaactcaccatggagtttgggctgacctggcttttctgtggctatttaaaaagtgtccagtgtgaggtncagctggtggagtcgtgggggaggcttagtacagccgtggggggtccctgagactctcctgacgcagccttcgtggattctcctttagtacgttatgccagtgaccttcgggtccgacccgaggccttaccccggaaagggggtaacggggtccgtagggtaggtcggggttctccgaaggtccgtagtttaggggtcgggtaagtgggttcgacccggtagggtaccaggttatttaaacccggtaaaagtcccctgggactaaccggggggccttaacgttttccgttttaacnccttacccgaaaggtacggtaaacctaaatttccccgaaaggggtaactaagttaccgttagaaccgtttccttagggaccttaagggttcgaacctagaccgttagaacggttacgacggtaaacggacgacggttaccgttaatactttaaggttcgtaagtttaaaccgtgggaaggtttgggtaccgtaacggttaactaccggtccggtttacgggggccgggtaaacccctttgggacccgttaccgctttccgg

SEQ ID NO: 170453 - DNA, 913 bp, Homo sapiens
  misc_feature: GYAE6OF02JFQJO.47.77.G11.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagagctcacgtacacgaccggtgctcgatttagctagtcactcaagggaaaggggctgagagaggagcccagccctgggattttcaggtgttttcatttggtgatcaggactgaacagagagaactcaccatggagtttgggctgacctggctttttcttgtggctattttaaaaagtgtccagtgtgaggtgcagctggtggagtcgtgggggagcttagtacagccgtgggggtccctgagactctcctgcgcagcctcgtggattctcctttagtagttangccatgtacttgggtccncaggctccgagggaacgggcgtggaggtgggtctcgaggctagttgggtggtaggtggttcgaccgtagggaacctacgtaacgttttaaaccggtaaaacggttccccgttagggaccgtaacgggggaccccgttaagtttttaccgttttaacgttccgttacccgaaagtaacggtaaacctaaacgtttacccgaaacgggtaaacctaacgtttaaccgttacggtacgtttttacccgtaggtaccggttaaggttttaaccgggaaacccctaaaggggttaaacccgttggggaaaacgggttaccggttacggggaaaaccgggttaacccggtaaccggggttaccccgtttaaaggtttaaaccgtttttaaggtttaacgggtttaaacggttttaaaagggtcggggggttaaacgttttacggggggtttaaccgggtaaacccggtttaaacccggttaaccgggttttaccccgggggtttacccggggggggggggttaaaccccccgggggttaaaacccccccggttttcggggggttttaaccccccggttaaaccccccggggttttcctttttaaaccccccgggg

SEQ ID NO: 170454 - DNA, 518 bp, Homo sapiens
  misc_feature: GYAE6OF02JMLNR.47.77.G11.1.454.CMB.1.raw
  modified_base (321)..(321): a, c, t, g, unknown or other
  misc_feature (321)..(321): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (479)..(480): a, c, t, g, unknown or other
  misc_feature (479)..(480): n is a, c, g, or t
  modified_base (483)..(507): a, c, t, g, unknown or other
  misc_feature (483)..(507): n is a, c, g, or t
  modified_base (509)..(518): a, c, t, g, unknown or other
  misc_feature (509)..(518): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgacccagactgagagtcgaggacacggcgtatattattgtagttaaatgggatggtggacttacgacttcgtggggccgggacctggccaccgtctcttcagcttccaccacggccatcggtctccccctggcgtccctaggctaccnggacgcacctccgtcgggggaccaacacgggccggtccccgtggggaccgtcgtcccgttgggaccgtaagggcccttaacgttccctacggttcggacgctcgttgacgggacggtccgtagggtaccaagggtccggacgactaaggntcgctnanncgnnnnnnnnnnnnnnnnnnnnnnnnnannnnnnnnnn

SEQ ID NO: 170455 - DNA, 446 bp, Homo sapiens
  misc_feature: GYAE6OF02FLGKO.47.77.G11.1.454.CMB.1.raw
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (411)..(412): a, c, t, g, unknown or other
  misc_feature (411)..(412): n is a, c, g, or t
  modified_base (414)..(416): a, c, t, g, unknown or other
  misc_feature (414)..(416): n is a, c, g, or t
  modified_base (418)..(446): a, c, t, g, unknown or other
  misc_feature (418)..(446): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatgggtgctacgactcgttggggccgggaacctggtcaccgtctcttcagcttccacaaggccatcgtcttcccctggcnccctgctccaggacncacctgtggggcacagcgcctgggctgcctgacaacggactacttcctagtgacgtctactgaggcgggctagggcctaagggcacgataggnncnnncnnnnnnnnnnnnnnnnnnnnnnnnnnnnn

SEQ ID NO: 170456 - DNA, 937 bp, Homo sapiens
  misc_feature: GYAE6OF02FICNX.47.77.G11.1.454.CMB.1.raw
  modified_base (183)..(183): a, c, t, g, unknown or other
  misc_feature (183)..(183): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttggctgacctggtctttttctgtggctattttaaaagtntccagtgtgaggtgcagtctgggtggagttcggtggggggaggtcttaggtaccaggcccggttcggggggtccctggacgtaccttcctccgtcggccgcgacgcccctcgtgggtacttttcccttacccgtttttaagttaaggtttacgttcgaccctagttcggtaccgtttccgggggtccccgtacccggtaacgggcccttacccgggaaagggggtaacgggggtcgttaggggggtacgggttggggttcctacgggacgggtaccgttaagggttttcggggttaggggtttaacgggtttgggggttaccgtacccggtaagggaaaacccttaaccgttaaaacggtttttaaaaccgggtaaaaacccgggtttcccccgttaacggggaccggtaaaccgggggggttaccccttttaaacgtttttacccggtttttaaaccgtttccccgtaacccggttaaacgggaaccgttaaaacccggttaaaccgtttaacccggaaacgggttaaaccctacgttaaaccgtacggttactttaccgtacggtacctaagggtttaccgaaacccgtggtaaccgtaggacgtaacggtacggacgggtaaccgtaccggtaccgttatttaagtttcgttaggttaaggtaacggttggggagtttagggtcggtaaccgtacggttacgttcccggggtacggggtaccccggggtaacgttcgggtcccttacccgg

SEQ ID NO: 170457 - DNA, 487 bp, Homo sapiens
  misc_feature: GYAE6OF02IABNR.47.77.G11.1.454.CMB.1.raw
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (449)..(451): a, c, t, g, unknown or other
  misc_feature (449)..(451): n is a, c, g, or t
  modified_base (454)..(487): a, c, t, g, unknown or other
  misc_feature (454)..(487): n is a, c, g, or t
tcagagctcacgtacacgaccggtgctcgattttagctagtcactcaaaggggaaaggggctggagtgggtctcaggcattgggtggtagtggtgccaggacacattaacgtaaagtccctgcagggccatttctttatctcagagacaattccaggacatactgattctgcagttgaccagactggagaggtacgaggaccaccggtcgtatatttatttggttagttaaatggggattcgggtggactacgagttccggttcgggggcccgggacctggtccacgtctcttcagtcttccacgacggcccatcgtccttccccgnggccgcctgctccgaggcncnccgngngggcagcgccggccgtggcctcgccgtgtacgaacgtcttaccctctacgngacgtccgtcngagggccgtcgtcggacgtagggcgactanagnnngannnnnnnnnnnnnnnnnnnnnnnnnnnnnnnnnn

SEQ ID NO: 170458 - DNA, 765 bp, Homo sapiens
  misc_feature: GYAE6OF02JUHUJ.47.77.G11.1.454.CMB.1.raw
  modified_base (418)..(418): a, c, t, g, unknown or other
  misc_feature (418)..(418): n is a, c, g, or t
tcagagctcacgtacacgaccggtgctcgatttagctagtcactcaagggaaaggggctgagagaggagcccagccctgggattttcaggtgttttctatttggtgatcaggactgaacagagagaactcaccatggagttggctgacctggtcttttcttggtggtacttaattttaaacggtgtccagttgtgagggtgacaactgttggcgtgtgggggatagttagtaccgtaccgtggggggtcccctaggtacgtactccttccgtcgtgacctagccctgtacgaccgtcttaccgttacgtaccaacttcggtctacgagttcgggtcgtcgggtacccgcgtacgggccgggttaccggggggaggcgttgggaggttcggtctacgagtatgagtgagagtggtcgancagtctagtaccggtagtccgtcgtggaacgggttcccgtacaccgttactcgtaccggtagacgtaaaccgttcggtttacgaacgggtcgtaaccgtacgtcgttacggttacctaaccgtaaaaccgtataacggacgtaccctagggtaacgtacggacgggaaccctagggtaacccggtaggtcccgttttaaagttcgtttccgaaacggttcgtaaccggtaagtttccggtaaacgtcggtaaccgttcggggaaccccccggtaccccgttaaccggccgttaccggttaacccttttacggtaccggggttacccgggttaaggttccccgggggg

SEQ ID NO: 170459 - DNA, 461 bp, Homo sapiens
  misc_feature: GYAE6OF02GN0NA.47.77.G11.1.454.CMB.1.raw
  modified_base (221)..(221): a, c, t, g, unknown or other
  misc_feature (221)..(221): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (417)..(418): a, c, t, g, unknown or other
  misc_feature (417)..(418): n is a, c, g, or t
  modified_base (421)..(423): a, c, t, g, unknown or other
  misc_feature (421)..(423): n is a, c, g, or t
  modified_base (426)..(461): a, c, t, g, unknown or other
  misc_feature (426)..(461): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaagngggatggtggctacgactcgttgggggccgggaacctggtcaccgtctcctcggcctccaccaaggccatcggtctcccctgccgcctgctccaggncacctccgagacncacgagccggcctgggctcggcctggtacaaggacttaccttcctatgtatactctggacgngggctgggacaaggcanaagtagnngtnnnagnnnnnnnnnnnnnnnnnnnnnnnnnnnnnnnnnnnn

SEQ ID NO: 170460 - DNA, 642 bp, Homo sapiens
  misc_feature: GYAE6OF02IQ29A.47.77.G11.1.454.CMB.1.raw
  modified_base (354)..(354): a, c, t, g, unknown or other
  misc_feature (354)..(354): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (604)..(604): a, c, t, g, unknown or other
  misc_feature (604)..(604): n is a, c, g, or t
  modified_base (612)..(612): a, c, t, g, unknown or other
  misc_feature (612)..(612): n is a, c, g, or t
  modified_base (627)..(627): a, c, t, g, unknown or other
  misc_feature (627)..(627): n is a, c, g, or t
tcagagctcacgtacacgaccggtgctcgatttagctagtcactcaaggggaaagggctggagtgggtctcaggcattggtgtagtggtgccaggacacattacgtaaagtccctgcagggcctattctttatctccagagacaacttccaggaacataactgattctgcagttcgaccagactagagagtcggaggtacaccggtccgtattattattagttacgtttaaaatgggattcgggtggtacctacgacgttcggttcgggggaccccgggtaacctgggtcctaccgtccttcttacgacgtcttaccccgaccgaacggtcccactccggttccttacccccgngccccgtccctacgcgacgacggacnccgtacccgtcgggttcggggcaaccgnggtcccggtaccggtcgggccgttcgtccggtaggttaaccgtacggtaaaccttcccgtaccggttacggtgaccgttcgttaccggtcggacgggcgggttaccgagggtaccacggggactcgtaaactcgagtgancgncgcgtgcngngtcagctgacgnacgngcgtgngtntcactancgacacgtacncgtacacngcgtacgcgtatccncgtcgtgcgtcgtcg

SEQ ID NO: 170461 - DNA, 723 bp, Homo sapiens
  misc_feature: GYAE6OF02I3BBA.47.77.G11.1.454.CMB.1.raw
  modified_base (190)..(190): a, c, t, g, unknown or other
  misc_feature (190)..(190): n is a, c, g, or t
  modified_base (242)..(242): a, c, t, g, unknown or other
  misc_feature (242)..(242): n is a, c, g, or t
  modified_base (405)..(405): a, c, t, g, unknown or other
  misc_feature (405)..(405): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (688)..(690): a, c, t, g, unknown or other
  misc_feature (688)..(690): n is a, c, g, or t
  modified_base (693)..(693): a, c, t, g, unknown or other
  misc_feature (693)..(693): n is a, c, g, or t
  modified_base (697)..(697): a, c, t, g, unknown or other
  misc_feature (697)..(697): n is a, c, g, or t
  modified_base (700)..(700): a, c, t, g, unknown or other
  misc_feature (700)..(700): n is a, c, g, or t
  modified_base (702)..(702): a, c, t, g, unknown or other
  misc_feature (702)..(702): n is a, c, g, or t
  modified_base (707)..(707): a, c, t, g, unknown or other
  misc_feature (707)..(707): n is a, c, g, or t
  modified_base (709)..(711): a, c, t, g, unknown or other
  misc_feature (709)..(711): n is a, c, g, or t
  modified_base (713)..(713): a, c, t, g, unknown or other
  misc_feature (713)..(713): n is a, c, g, or t
  modified_base (716)..(716): a, c, t, g, unknown or other
  misc_feature (716)..(716): n is a, c, g, or t
  modified_base (718)..(722): a, c, t, g, unknown or other
  misc_feature (718)..(722): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgtacttctgctagttagaccagactgagngtacgaggacacggccgttattactttcgtgtcgacgtaaagtctaatacgngcgtacggcccccttaaggccgacctacgtttcctttcgtaccgttccgtacgggggaccacggggtaacttccggttcggtccacccggttctacccaacgtcctacccgttacccaaccgtaacgggtcccctaacgttccccggtacccgtttcccccgnggcccccgtacccccgtttcgacccgttccggaaccggaccggtaaccccaccccgttcccgaaaccggtacgacccgtaaaccgtccggacccgtcccccgggtggggtacctttccggaccccggtttaggggttaaacccgtaacgggttaaaccccgtttccgtttaacccgtagggttcccgtaaacttcccgggttaccgtacggggttacggacccggggtttcgacggggaaccccgtagggcccgttaagtaacggcctgacgtcangngcncnnncancgcncancngctcnannnangcngnnnnnc

SEQ ID NO: 170462 - DNA, 894 bp, Homo sapiens
  misc_feature: GYAE6OF02JCJYN.47.77.G11.1.454.CMB.1.raw
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttgggctgacctggtctttttcttggtggcttaattttaaaaagtgtcctagtgtgaggtgcagctggtggagtcgtgggggagcttagtacagccggtgggggtccctggacgacgttctccgtgcgcacgcctcgtggattccttccgttttaagtagttatcgacctatacgtagttccgggtcccgaccgacggccttacccggaaggggtaaacgggggtcctaggggtacggttacggggtaccgttcggaacggtcgttaggtttacgggtagggtaaggtttgggtaccgtacccgaaggggaacctaacgtaaacgtttaaaccggttaaaacgtccccgtaggacccgaacggggtaccgtaagtttttaccttttacgtccgttaaccccgaaggtaaacgtaaaccgtttaaactttaacccggaaacgggtaaaacctaacgtttaaaccggtaggtttaaccttttaccgttaaggaccgttaaacgggtttacggaaaccctaaagtaacccggttacgggagtaaaccggtacggggaaagtacccggtaacggtaaaccggttaaatttaacgttttaagtttcgggtttaaaagtttaaacgggttacgggtaaggttacggggtaaacggttacccgtaaagggttaccccgtttttaaccgggggtaccgggggggtaaccccccgggggttaaaaccccttttgggggaaccccccgtttaaccccgggg

SEQ ID NO: 170463 - DNA, 439 bp, Homo sapiens
  misc_feature: GYAE6OF02JEPAY.47.77.G11.1.454.CMB.1.raw
  modified_base (219)..(219): a, c, t, g, unknown or other
  misc_feature (219)..(219): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (413)..(420): a, c, t, g, unknown or other
  misc_feature (413)..(420): n is a, c, g, or t
  modified_base (423)..(439): a, c, t, g, unknown or other
  misc_feature (423)..(439): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattatgtgttaaangggatggtggctacgactcgttgggggcccggggaaccctggccaccgtctcttcagcttccaccaaggcccatcggtcttcccccnggcnccctgcctccaggancacctcgtaggggcanagcggcccgtgggcctgcctggcaaggactcttcctacgngacgctctgagcggtcgngcgacggcncatgnnnnnnnngtnnnnnnnnnnnnnnnnn

SEQ ID NO: 170464 - DNA, 510 bp, Homo sapiens
  misc_feature: GYAE6OF02GBHL5.47.77.G11.1.454.CMB.1.raw
  modified_base (306)..(306): a, c, t, g, unknown or other
  misc_feature (306)..(306): n is a, c, g, or t
  modified_base (465)..(465): a, c, t, g, unknown or other
  misc_feature (465)..(465): n is a, c, g, or t
  modified_base (467)..(469): a, c, t, g, unknown or other
  misc_feature (467)..(469): n is a, c, g, or t
  modified_base (472)..(474): a, c, t, g, unknown or other
  misc_feature (472)..(474): n is a, c, g, or t
  modified_base (476)..(510): a, c, t, g, unknown or other
  misc_feature (476)..(510): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggcgtatattattgtagttaaatgggatggtgctacgactcgttggggaccgggacctggtcaccgtctacttcagtcttccacgaacggccagtccgtccttccccgngccgtcctcgctccgaggacgcctaccgtccgtggggaccacgtacggcccgacccgtgggccgttcgaccgttggtacacggtacttaccgttcctacggtgacggtactcgtaggacggtcggggtactcggggactaacgggtcgacgtatacggntnnngcnnngnnnnnnnnnnnnnnnnnnnnnnnnnnnnnnnnnnn

SEQ ID NO: 170465 - DNA, 602 bp, Homo sapiens
  misc_feature: GYAE6OF02F50VP.47.77.G11.1.454.CMB.1.raw
  modified_base (212)..(212): a, c, t, g, unknown or other
  misc_feature (212)..(212): n is a, c, g, or t
  modified_base (375)..(375): a, c, t, g, unknown or other
  misc_feature (375)..(375): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (593)..(596): a, c, t, g, unknown or other
  misc_feature (593)..(596): n is a, c, g, or t
  modified_base (600)..(601): a, c, t, g, unknown or other
  misc_feature (600)..(601): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacagtactgattctgcagttgacagactgagagtcgaggacacggccgtatactttcngtgcgaaagtctaatagcagtcgacccccgtagcgctacttctttgacctttcgtcggggccaagggactccgtggtccaccgtctccacacgcctaccaaccgaacgggccctagttccggtccgtttcccccgagggcctcccgtgcctaccgagggtacnccaccgtccgaagacgacacgacggaccgggtcccgtaggggctacggccgtttagggacccgtaaagggtacctttaccgtttacccgtaacggttacggaacggtccttacggtacggaacggccggggtcttacggggaccaaacgggcccgacgtaagtacgctacgcacgtcncgacgncacgacncgcgcgcgagcngngngnnngncgncnnnncacnnc

SEQ ID NO: 170466 - DNA, 533 bp, Homo sapiens
  misc_feature: GYAE6OF02IO6M8.47.77.G11.1.454.CMB.1.raw
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
  modified_base (499)..(533): a, c, t, g, unknown or other
  misc_feature (499)..(533): n is a, c, g, or t
tcagagctcacgtacacgaccggtgctcgatttagctagtcactcaagggaaaggggctggagtgggtctcaggcattggtggtagtggtgccaggacacatttacgtaaagtccctgcagggccgattctttatctccagagacaattccaggaacatactgatttctgcagttgaccaagactgagagtcgaggacacggcctatatttattgtagttaaatgggtatggtggntacgtacgttcgttcggggcccgggtacctggtccaccgttctcttcagtccttaccgaccaacggcccatcccggttccttcccccgttggcccgccccgttgcctccgaggacnccaccgtcggtcgggggcacgcggtccggccgtcggggtacctcggtccgtcggttaccgaaacggtttccttaaccttccgtacggtggacgtccgttcgtcggacgggtccgggtactcgggacggaacggcggacctagagtgnnnnnnnnnnnnnnnnnnnnnnnnnnnnnnnnnnn

SEQ ID NO: 170467 - DNA, 797 bp, Homo sapiens
  misc_feature: GYAE6OF02I3UMV.47.77.G11.1.454.CMB.1.raw
  modified_base (233)..(233): a, c, t, g, unknown or other
  misc_feature (233)..(233): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagttgggctgacctggtctttttcttgtggcttaattttaaaagtgtcagtgtgaggtgcagctggtggagtcggtgggggagtcttagtacncggtccggtcgggggtcctaggacgtactcctccgtgccgcacgcctcgtacggtactttccttaccgttttaaggttagttacgtcgcctagttgtacggtttccgggtcccgtccgacggtccgtacgggaagggggaacggggtcgtagggtacgggttcgggtcttaccggagggtacgtaggtttggggttagggtaggttcgggtccgtaccggaaggtaacctaaacgttaacgtttaaaccggtaaaccgtcccgtacggtaccggtaccgggtacccgttactttacgtttacctcccgtacgtaagtactaactacgtaccgaaggtaactatactagtacttctacgtacgtgtacgaccgtagtacgtagagtacgtaacggacggtaaccgtacggtaccttaagttaaccgtttagttacgggtttaagtttaacgggtagggttacggttacgggtacggttaccggtaaccgggttacggttacccgggggttaacccggggggtaccccgggttaacccggttccggggtttacccgttaaccccgg

SEQ ID NO: 170468 - DNA, 741 bp, Homo sapiens
  misc_feature: GYAE6OF02JNZXS.47.77.G11.1.454.CMB.1.raw
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (456)..(456): a, c, t, g, unknown or other
  misc_feature (456)..(456): n is a, c, g, or t
  modified_base (607)..(607): a, c, t, g, unknown or other
  misc_feature (607)..(607): n is a, c, g, or t
tcagagctcacgtacacgaccggtgctcgatttagctagtcactcaagggaaaggggagctctgagagaggagcccagccctgggattttcaggtgttttcatttggtgatcaggactgaacagagagaactcaccatggagtttggctgaccgtggtctttttcttgtggacttaattttaaaagtgtccagtgtagaggttgctagtcgtggttggngtccggtgggggagtccgttagactcgtccggttcgggggtcccnggacgctcgtctgcgcacgcctgtgtnttaccgttcttagttagttancgacatcgtcgttcggccaccgtcgcgtccggagggacgggtctacggtaggtcggtcccgagtacgtcgtagttcgggttcgggtagttacgggtccgtaccgaggacctacggtaacgtttaaacccggtaacgttacccgnggcccggtaacggggtaccctttaacgttttccgttttaccgacccgtaccgttaaaggacccgtaaacttaacccgggttaaacacgttaaaaccgtaccttagtaccggttatttaccgtagtacgtagtacgtaaccacgttaacggngtacggtacgtaccgagtaccgtaccgtaagtacttactttagtcgttaacaacgggtagtcggttacgtacggtaaccgttgtaacccggttcgggtacccgggtaaccgggtaccgttccggtaccgttccg

SEQ ID NO: 170469 - DNA, 632 bp, Homo sapiens
  misc_feature: GYAE6OF02H6MWA.47.77.G11.1.454.CMB.1.raw
  modified_base (217)..(217): a, c, t, g, unknown or other
  misc_feature (217)..(217): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (569)..(569): a, c, t, g, unknown or other
  misc_feature (569)..(569): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (593)..(593): a, c, t, g, unknown or other
  misc_feature (593)..(593): n is a, c, g, or t
  modified_base (602)..(602): a, c, t, g, unknown or other
  misc_feature (602)..(602): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
  modified_base (628)..(629): a, c, t, g, unknown or other
  misc_feature (628)..(629): n is a, c, g, or t
tcagagctcacgtacacgaccggtgctcgatttagctagtcactcaagggaaaggggctggagtgggtctcaggcattggtggtagtggtgccaggacacattacgtaaagtccctgcaggccgattcttatctcagagacaattccaggaacatactgattctgcagttgaccagactgagagtcgaggacacggcgtatattattgtattaaagnggatggtgctacgactcgttggggacccggtaacctggtaccaaccgttcttcgttacgacgtacttacccaaccgaacgggacccaagtcccggtcctttaccccccgtggcccgtacccgtcgaccttcccgaaggggtacgaccgtacccttacggtacgggggaccaaccggtaacggccggtaccccggttgggaccgttacggccgttaggttaccgaaacggtaccttaacccgttccgtttaacggtcgtaacgtccgtacctacgggtaacggtcgggacccgtaggaccgaaacggggaccacgtaacgtagagagcagaccagancanacgacgtcgacanacgtagacagnagtanacgcagtntacgagatngtcgacncananangacgcangacgnngta

SEQ ID NO: 170470 - DNA, 823 bp, Homo sapiens
  misc_feature: GYAE6OF02JIJSU.47.77.G11.1.454.CMB.1.raw
  modified_base (74)..(74): a, c, t, g, unknown or other
  misc_feature (74)..(74): n is a, c, g, or t
  modified_base (87)..(87): a, c, t, g, unknown or other
  misc_feature (87)..(87): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (281)..(281): a, c, t, g, unknown or other
  misc_feature (281)..(281): n is a, c, g, or t
  modified_base (763)..(763): a, c, t, g, unknown or other
  misc_feature (763)..(763): n is a, c, g, or t
tcagagctcacgtacacgaccggtgctcgatttagctagtcactcaagggaaaggggagctctgagagaggacncccagccctgggnttttcaggtgttttcatttggtgatcaggactgaacagagagaactcacagtggtagttgggctgaccgtggtctttttcttgtggtcttaattttaaaagtcgttccagttgtgtaggngcngcgtgggtggagtcggtgggggagtcgttagactggcggttcgggggcctgacgactcgttcgtcgcgtcncgtcccgtgtggtcctttacgttccgtttaagtacgtagtcggcctagtccgttacggttccgggtcccggccgtcggtccgtacccggtaagggggtaacggggtcgtacggggttaggtccgggtacgttcggaggtaccgttaagggtttggggttcgggttagggtcgggttaccggaccgaaccggacccggttaaagttactttaaaccgggttaaaccccgttcccgtcggaccggggtacggttccgtttaaaccgtttccgtacctaaaccgtcccgaagttacaaaccgtttactaccggtaacgtaaacgtaactaccgtacggtttaagtaccgttagtaccgttaacggttacccgacccgtaaagttaccggaggtaaccgttacggggtaacgtaaccgtaaccggtaccgggttacgtaaagtttaccgtagttttagttaaggttaagttcgggttagttacggnggtaacgtacgttcgggttacgggttacccggggaacccgtcggttaccgtccttaccgg

SEQ ID NO: 170471 - DNA, 769 bp, Homo sapiens
  misc_feature: GYAE6OF02FF8VD.47.77.G11.1.454.CMB.1.raw
  modified_base (185)..(185): a, c, t, g, unknown or other
  misc_feature (185)..(185): n is a, c, g, or t
  modified_base (422)..(422): a, c, t, g, unknown or other
  misc_feature (422)..(422): n is a, c, g, or t
  modified_base (505)..(505): a, c, t, g, unknown or other
  misc_feature (505)..(505): n is a, c, g, or t
tcagagctcacgtacacgaccggtgctcgatttagctagtcactcaagggaaaggggagctctgagagaggagcccagccctgggatttcaggtgtttcattggtgatcaggactgaacagagagaactcaccatggagtttgggctggagctcggctcttacgttgtggtacgtttttaaaggngtaccgtagtgtagacggtgcaacgtgtaggacgtacgtggggagacttagtaccgaccggtgggggtacccctaggacgtactccgtacttcggcgtacgacgtaccgttccgtacgggtacctactaaccggttttcgacctaaaccttcgtacgtaacctggtacgggtcctcggggttacccgacgacggtccgtaccggaaggtacggacgtggaagtgtatacgcttaacncgtagaggttacgtaggtacgttactaactagtaacgtaccgtaacacgtacgtaaccgttcgtagggtagtaacccggggtntaaccgttcgaccgttccgtaaccgacggtaacccaccggaacccgtaaggtaaccgacgttaaggttacgtaccgttacgtacggaccgtaaagtacgaacgttacgaccgttaggacgaaaccggtacgaaccggtacgtacccggttacgtttaacgtcgttaccggacggttaccggaacggccggttaccctacccgttaccgtaccgttacgttaccggtttaaccggcggttaaccgtcgggtacccggtaacccgg

SEQ ID NO: 170472 - DNA, 636 bp, Homo sapiens
  misc_feature: GYAE6OF02GD2NZ.47.77.G11.1.454.CMB.1.raw
  modified_base (136)..(136): a, c, t, g, unknown or other
  misc_feature (136)..(136): n is a, c, g, or t
  modified_base (285)..(285): a, c, t, g, unknown or other
  misc_feature (285)..(285): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (553)..(553): a, c, t, g, unknown or other
  misc_feature (553)..(553): n is a, c, g, or t
tcagagctcacgtacacgaccggtgctcgatttagctagtcactcaaggggaaagggggctggagtgggtctcaggcattggtggtagtggtgccaggacacattacgtaaagtccctgcagggccgattctttanctccagagacaattccaggaacatactgattctgctagttgaccagactgagagtcggaggacacggcgtatattattgtagttaaatgggatgggtggactacggacttggtcgggggccgggaaccttgggccaccgtcttacgttnacgtctccgaccgaacgggcccagttccggtccttccccgtggcccgcccgtagcctaccgaggtacgctaccgtcggtcgggggcacgcgccggcccgtgggactcgggtccgtcggtacgaacgggtaccttaccgttacctacgggtacggtacgttaccgtccgtaacggccgggtccggggtaccgttcggggacgtaaaccgggcggtaccgtaaattcggggactggactagacgtgtgngtattnacgttnacgcgacgngtcgcgtgcgtacgcgtacgtcgtacgacgagtcgtacgactacgtacgagcgctgactacgtctcgtcgtcgtacgtatacg

SEQ ID NO: 170473 - DNA, 830 bp, Homo sapiens
  misc_feature: GYAE6OF02FMMGJ.47.77.G11.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
tcagagctcacgtacacgaccggtgctcgatttagctagtcactcaagggaaaggggagctctgagagaggagcccagcccctgggattttcaggtgttttcatttggtgatcaggactgaacagagagaactcaccatggagtttggctgaccgtggtctttttcttgtggacttattttaaaaagtgtccagtgtgaggtgcagctggtggagtcgtgggggagnttagtacngccgtgggggtaccctggacgctcctcctgtcgccgagtcctcgtggtacttccttacgtttacgttagtttacgtacgacctagttacgtaccggttcgggttccgaaccgtacggtcccgtaccggtaacggggttaacggggcgttacggggacggttggggttacctacgggacggttaccggtaaggttttcggggtaacggggttacggttacggggttccgaccgggtaacggtaaccgttaaacggtaaacgtttaaacccggtaaaaccggttaccccgtaggggtaacccgtaccggggtaccgttaacgttttacctttaacggtacccgtacctaacgggtaaacctacggtaaacccgtttaccgaagggttaaaacccttaaggtacgttaacgtcttttacccggattaccggtaacgttccgaaaccggttacgtaccgtaggagttaccgtacggaccggtacggaaccggttacgtaattacgttacgttagtaacggttaacggtggtacttccgggtagtaccgttaaccggtgtttcccggtaaggggaccccgttacgtcggtacccttaccg

SEQ ID NO: 170474 - DNA, 728 bp, Homo sapiens
  misc_feature: GYAE6OF02G53T5.47.77.G11.1.454.CMB.1.raw
  modified_base (231)..(231): a, c, t, g, unknown or other
  misc_feature (231)..(231): n is a, c, g, or t
  modified_base (344)..(344): a, c, t, g, unknown or other
  misc_feature (344)..(344): n is a, c, g, or t
  modified_base (554)..(554): a, c, t, g, unknown or other
  misc_feature (554)..(554): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (620)..(620): a, c, t, g, unknown or other
  misc_feature (620)..(620): n is a, c, g, or t
tcagagctcacgtacacgaccggtgctcgatttagctagtcactcaaggggaaaggggctgagaggaggagcccagccctgggattttcaggtgttttcatttggtgatcaggactgaacagagagaactcaccatggaggtttgggctgacctggtctttttcttgtggtcttaattttaaaagtgtcctaggtgttgaggtgcgagcgtgggtggacgtcggtgggggngtcttacggtactacggtccggtcgggggggttccctagcgtaccgtcctaccgtgccgacagtcctgtggtcttcttacgtttagtattgtcgctatcgacttcggggtccncgacggtcgacggaacggggtacgggcggtgggtacggttcgggtctccggtaggtcttagggttgggtgggttaggtacgggtcgtaccgacggaactacgttacggtttaaacggtaaccgtcccaggtcggaacgggccgtttatttaacttttaccgcgttacgtacgaacgtactaaccgttacgaaggactactactgtacttnagtacacgtacgtacgancgngagtacgtacggaccggacgtacggtacgttattagttaacgttnttaacggtttaggtacggttaggtagggttacggtgttaacccggtggttaccgggggttcgggtacccgggggttcctaccgggggttaccctccgttcgtttaccg

SEQ ID NO: 170475 - DNA, 544 bp, Homo sapiens
  misc_feature: GYAE6OF02JBLMB.47.77.G11.1.454.CMB.1.raw
  modified_base (326)..(326): a, c, t, g, unknown or other
  misc_feature (326)..(326): n is a, c, g, or t
  modified_base (441)..(441): a, c, t, g, unknown or other
  misc_feature (441)..(441): n is a, c, g, or t
  modified_base (495)..(495): a, c, t, g, unknown or other
  misc_feature (495)..(495): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (511)..(515): a, c, t, g, unknown or other
  misc_feature (511)..(515): n is a, c, g, or t
  modified_base (517)..(540): a, c, t, g, unknown or other
  misc_feature (517)..(540): n is a, c, g, or t
  modified_base (542)..(544): a, c, t, g, unknown or other
  misc_feature (542)..(544): n is a, c, g, or t
tcagagctcacgtacacgaccggtgctcgatttagctagtcactcaagggaaaggggctggagtgggtctcaggcattggtggtagtggtgccaggacacattaacgtaaagtccctgcagggccgattctttatctccagagacaattccaggaacatactgattctgcagttgaccagactgagagtcgaggacacggccgtatattattgtagttaaatgggatgggtggctacgactcgttcggggccgggaacctggtccaccgtctcttcagtcttcccaccgaacggggcccagttccggtcctttcccccctgggccncccctgcctccgaggacgccacctcggtcgggggctaccgaggccggcccgtggggcctcggccgtacggtacgaacgggtacctaccgttaccgttcggtcgtacgtcttccgnggtacgggcggggtacgtcgggtacgaacggggccgacgtaatcggacgcgtgngcnngntgngngcgcnnnnncnnnnnnnnnnnnnnnnnnnnnnnncnnn

SEQ ID NO: 170476 - DNA, 844 bp, Homo sapiens
  misc_feature: GYAE6OF02G5GL4.47.77.G11.1.454.CMB.1.raw
  modified_base (238)..(238): a, c, t, g, unknown or other
  misc_feature (238)..(238): n is a, c, g, or t
tcagagctcacgtacacgaccggtgctcgatttagctagtcactcaagggaaaggggagctctgagagaggagcccagcccctgggattttcaggtgttttcatttggtgatcaggactgaacagagagaactcaccatggagttgggctgacctggtctttttcttgtggtcttaatttaaaaagtgtccagtgtgaggtgcagctgggtggaggtcgtgggggaggtcttagtacnggccgtgggggtccctgacgactcctccgtgcgcacgcctcgtgtattccttcctttaagtagttatcgtacctagttcgtacgtttcggggtacccgccgtacggtccgtaccggagggggtaacggggtcgttggggagggttgggtccgtcggagggtcgtaggttcgggtgggttacggttagggtcggaccgtagggaacaacgtaacgtttaaaccggtaaacgtccccgtaggaccggaacgggtaccgttattttaccgtttaccgttaccctcgtaaacggtacgtaaaccgttaaccgttaaccggtaacggtaaaccttaacgttaacgtacggttaacgtttccgttaggtaccgtaacggttaccgaaccgtaacgtaccgtacggtacggtaacggttaacggaaccggtaaccggaaccggttacccgttaaagttaaccggttttaaggtttacggtttaaggtttaaagggttcggggttaacggttcggggttacggttaacccgtttacggttaaccggtttccggggttaaccggggggtaacccccgggttaacccgggttaccgggttacccggttaaccccgg

SEQ ID NO: 170477 - DNA, 462 bp, Homo sapiens
  misc_feature: GYAE6OF02ILNAG.47.77.G11.1.454.CMB.1.raw
  modified_base (220)..(220): a, c, t, g, unknown or other
  misc_feature (220)..(220): n is a, c, g, or t
  modified_base (410)..(410): a, c, t, g, unknown or other
  misc_feature (410)..(410): n is a, c, g, or t
  modified_base (439)..(439): a, c, t, g, unknown or other
  misc_feature (439)..(439): n is a, c, g, or t
  modified_base (441)..(462): a, c, t, g, unknown or other
  misc_feature (441)..(462): n is a, c, g, or t
tcagagctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaangggatggtgctacgctcgtggggccgggacctggtcaccgtctcttcagtcttccgaccaacgggcccagtccggtccttcccccgtggccgccctgccttccgagggacgccgacctcggtcggggccacgacggccggcctgggctcggccgtggtcaaggtcctaccgttcctacgtgacgtctcgngacggcgggcgtcggacgaaggcgacagngnnnnnnnnnnnnnnnnnnnnnn

SEQ ID NO: 170478 - DNA, 448 bp, Homo sapiens
  misc_feature: GYAE6OF01CC5GB.15.87.H10.1.454.CMB.1.raw
  modified_base (441)..(448): a, c, t, g, unknown or other
  misc_feature (441)..(448): n is a, c, g, or t
tcagtctacgtagccacgaccggtgctcgatttagcagtactgcgttgggtttgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtcgtggggccaagggaccacggtcaccgtctcctcacgcctccaccaagggccccatccggtccttcccccctggccacccctcctaccaacgacgccaccctcgtcgggggcacgacgccggcccgtgggctcgcctggtcaaggactactccgctacgtagactgacggcggctggacaagggcgcatagnnnnnnnn

SEQ ID NO: 170479 - DNA, 564 bp, Homo sapiens
  misc_feature: GYAE6OF01CZJEJ.15.87.H10.1.454.CMB.1.raw
  modified_base (345)..(345): a, c, t, g, unknown or other
  misc_feature (345)..(345): n is a, c, g, or t
  modified_base (402)..(402): a, c, t, g, unknown or other
  misc_feature (402)..(402): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
tcagtctacgtagccacgaccggtgctcgatttagcagtactgcgttgggtttggggctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatcttttaatagtttttggatgaccttgggtccgccagggtccgaggggaaggggctggagtgggtggccaanataaagcaagatggaagtgagaaatactatgtgactctgtagagggcattcacatcnccagacgacaacgaccaagtaacttactgtatcngacaaatgaacagcctgaagacggcgaaggactagtggcttntgttaattctggtacgcggaaggtactacccgtccctggtcgggccggccgttacgggtttccacgggtcaggtcgggtaaccggg

SEQ ID NO: 170480 - DNA, 530 bp, Homo sapiens
  misc_feature: GYAE6OF01D0NCJ.15.87.H10.1.454.CMB.1.raw
  modified_base (517)..(530): a, c, t, g, unknown or other
  misc_feature (517)..(530): n is a, c, g, or t
tcagtctacgtagccacgaccggtgctcgatttagcagtactgcgttgggtttgggtggccaacataaagcaagatggaagtgagaaatactatgtggactctgtgaagggccgattcaccatctccagagacaacgccaagaacttactgtatctgcaaatgaacagcctgagaggcgaggacacggctctgttattactgtgcgaggtactacctcctcgtgggccgggcctacggtttccacggcagtcgggacgtcggtcggggaccgaacgggaccgacggtccaccgtcctcctcacgccctccaccgacggccctacgtccggttccctttcccccgtcggccctaccccgtccctaccaacggacgccacccgtcggtcgggggccacgacggccggtcccgtgggtccgtcgccgtcggtacgaaacggtaccttaccgttcccgtaccttaacggtacgacgttcggacgggccgggtccgtcgggacgaacgggccgacacgtagnnnnnnnnnnnnnn

SEQ ID NO: 170481 - DNA, 593 bp, Homo sapiens
  misc_feature: GYAE6OF01ALUSD.15.87.H10.1.454.CMB.1.raw
  modified_base (443)..(443): a, c, t, g, unknown or other
  misc_feature (443)..(443): n is a, c, g, or t
tcagtctacgtagccacgaccggtgctcgatttagcagtactgcgttgggtttggggctcagagaggagccttagccctggactccaagacctttccacttggtgatcagcactgagcacagaggactcaccatggaattgggactgagctgggttttccttgttgctattttagaaggtgtccagtgtgaggtgcagttggtggagtctggggggaggcttggtccaaccgtggggggtccctgagactctcctgtgcagcctctggattcatctttaatagttttggatgacctgggtccgccaggggtccaggggagggctgggagtgggtggccaacagtaaagcaagagtaggaagtgaagaaatactatgtggactctgtgagggccgtatcacctatctacagacgacaacgccaaagtaacttactgtatcgtanacaaatgaacagcctgagacggacgtacggactagtcgggcttcgtagttaacttacggtcgtgggaccgaaggtcctaccccttccggtccgtacggggcccggggtaccttacggggtttccccgaacgggcttaggtcgggtaccgg

SEQ ID NO: 170482 - DNA, 443 bp, Homo sapiens
  misc_feature: GYAE6OF01E44YJ.15.87.H10.1.454.CMB.1.raw
  modified_base (426)..(426): a, c, t, g, unknown or other
  misc_feature (426)..(426): n is a, c, g, or t
  modified_base (432)..(443): a, c, t, g, unknown or other
  misc_feature (432)..(443): n is a, c, g, or t
tcagtctacgtagccacgaccggtgctcgatttagcagtactgcgttgggtttgggtggccaacataaaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctgggggccaagggaccacggtcaccgtctcctcagcctccaccagggcccatcggtcttcccctggccaccctcctccaagacgcaccctcgtcgggggcacgagcggccctcggggctgcccgtggtcgaaggactacttccgctacgtagactgacgcgggctggcaagggcncatagnnnnnnnnnnnn

SEQ ID NO: 170483 - DNA, 822 bp, Homo sapiens
  misc_feature: GYAE6OF01DTOOW.15.87.H10.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (624)..(624): a, c, t, g, unknown or other
  misc_feature (624)..(624): n is a, c, g, or t
  modified_base (697)..(697): a, c, t, g, unknown or other
  misc_feature (697)..(697): n is a, c, g, or t
  modified_base (798)..(798): a, c, t, g, unknown or other
  misc_feature (798)..(798): n is a, c, g, or t
tcagtctacgtagccacgaccggtgctcgatttagcagtactgcgttgggtttggggctcagagaggagccttagccctggactccaaggcctttccacttggtgatcagcactgagcacagagactcaccatggaattgggactgagtcgttggttttccttgttgcttatttagaggtntcagtgtgagtgntagtggtggagtcggtgggggagtcgttggtacccgtaaccggttcggggggtcccttaggacgtaccttccgtacccgtggtcgacacgtcccgttntaggtactttacgaagttttacttttaaagttttaaggtttttaggagttaccggtaaccggttcggggtaccccgtcgggtaacggggtaacccggtagggggaacgggggtaccttggggacgggtttagggaccgggtaacccaaaagtaagttaaaaaggacgtaaaaggagtagggtaaagtacgtaaagtaaaatacgttaagtaggtactacgttagtaggtacggtaacggggaccctaacgtttaccaaccgtacgttacctaacgaagtaacgaacccgaaacggtaaccctaaagtaacctttacgtaggttatacgttanaaaccggtaaattacccggaaataccggtaacgtagggaaacgcgggaacggacggtaactcggtaaccggtnttaacgtagttaacctttaggtcggtaagacgggaacggttaccctacgtttaccccgtgggtaccgggttaccgacccgttaccgggttttacggaaccngtttacggggaagttaccccgggg

SEQ ID NO: 170484 - DNA, 761 bp, Homo sapiens
  misc_feature: GYAE6OF01AIRH6.15.87.H10.1.454.CMB.1.raw
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattcttttaaagttaggtttttggatcgaccgtgggtcccgccgaggggtccgaggggaaggggtctgggaggtggggtacgaccaaacaagtaaagcgaaggagtaggaaagtaggaagaaaatactagtggtacggactcgtaggtaggaacgggccgtacttccacctactcctacgaaggaacgaccaaccgacaaacgtaacttacgtgtactctagaactaaagtacgaacgacgtccgaaggaacggacgggacggaacgtaccgacggtctacgttagtacgttacgtggacgacgtaggtaccttacccgtctcgggtcggtccggtaccgttaccggttccgacggtctaggtcgggtacgtcgggtacgggacccgaacgggtcccgtacggtccctaccgtcctcccgtcgtacccaccccacccgtaccgaacccggtcccgtaccggttcccgtccccgttccccgtccgtacccctaccccgtaccgtaacccgtacggaccctccgtacccggtgggtccgggaccaccgggtaccgccccgggtccgtacggccgttccgcccggttcggtaaccgg

SEQ ID NO: 170485 - DNA, 592 bp, Homo sapiens
  misc_feature: GYAE6OF02I2DS8.15.87.H10.1.454.CMB.1.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaaagcaagatggaagtgagaaatactatgtggactctgtgaagggccgattcaccatctccagagacaacgccaagaacttactgtatcagcaaaatgaacagcctgagaggcgaggacacggctctgtattactgtgcgaggatacctcctctgggccgggccacggtttccctacggcatggacgtcgtggggccgaagggaccgacggtcaccgtctcctcacgccctccaccaacgggcccacgtccggtccttcccccgtcggccctacccctccctacccaacgacgaccgacccgtccgtcgggggaccaccgacggccggcccgtcgggccgtcgccgtggtaccg

SEQ ID NO: 170486 - DNA, 558 bp, Homo sapiens
  misc_feature: GYAE6OF02HFEPZ.15.87.H10.1.454.CMB.1.raw
tcagtctacgtagccacgaccggtgctcgatttagcagtactgcgttgggtttggggctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtggccaacataaagcaagatggaagtgaagaaatactatgtggactctgtgaagggcgattcaccatctcagagacaacgccaaagaacttactgtatctagacaaatgaacagcctggagaggcgaggacatggctcgtgtatttacgtgtgtgaggtagattggttcgtggtcgggtttcgggggacccgaacggggtaaccccgttcggggtccacccggttcccg

SEQ ID NO: 170487 - DNA, 451 bp, Homo sapiens
  misc_feature: GYAE6OF02G2IE9.15.87.H10.1.454.CMB.1.raw
  modified_base (441)..(451): a, c, t, g, unknown or other
  misc_feature (441)..(451): n is a, c, g, or t
tcagtctacgtagccacgaccggtgctcgatttagcagtactgcgttgggtttgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctgggccgggccaggtttccctacggcatgggacgtcgtggggccgaaggggaccacggtcaccgtctcctcagcctccaccaacggccccatccggtcttcccccgtggccaccctcctccagagcacctcgtggggcaccagccggcccgtggggcctgccgtggtcaaggactacttccgctacgtagactgacgcgggcgtcggacgtaggcgcagtagnnnnnnnnnnn

SEQ ID NO: 170488 - DNA, 691 bp, Homo sapiens
  misc_feature: GYAE6OF02F0T2E.15.87.H10.1.454.CMB.1.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaagggctggagtgggtgccaacataaagcaagatgggaagtgaagaaatactatgtggactctgtgaaggccgattcacatcctccagagacaacgccaaagtaaccttactgtatctgacaaaatgaaacagcctaggaggaggcgaaggaccacggctctagtattacgtgtgcggagtactacccgtcctacgtcgggccgggtaccgtacggtttccgtacggcgtacgtcgggacgtccggtcgggggaccgtaaacggggacccgtaccggtccgacccgttcctcccgtccaccgtcccgtacccgaaccggaaccgggccccgtacgttcccgggttccccttacccccggtcgaccccctacccccgttcccgtaacccgacgacccgtacccgtacccgttccgggtcggggaccctacggaccgggccccggtccggtccgggtccgtccggtcccgtcggtaaccgg

SEQ ID NO: 170489 - DNA, 716 bp, Homo sapiens
  misc_feature: GYAE6OF02HOA6G.15.87.H10.1.454.CMB.1.raw
tcagtctacgtagccacgaccggtgctcgatttagcagtactgcgttgggtttggggctcagagaggagccttagccctggactccaaggcctttccacttggtgatcagcactgagcacagaggactcaccatggaattgggactgagctgggttttccttgttgctattttagagtgtcagtgtgaggtgcagttggtggagtcgtgggggaggcgttggtccaaccgtgggggtccctggacgactccgtcctgtcgcagtcctcgtggtacttctagttactttaattaggtttttggattcggtaccgttcggggtaccgccggtagggtacccgaagggggaaggggtcgtagggacggtgggtacggaccaaacgaagtaaaaggacgaaaggagtagggaagtagaaagtaaattacgtagtggtaggtacgttcgtggtacggaacgggtccgtaagttaccaacgtacttcgtaccgaggtaacaaccgaacgtaacccgaaagtaacctttacgtgtaacttcgtagtaacctaaaagtcgaaacgacgtccggtaaggacgggaccggacgtaacgggactaaggttcggccttacgttagttaacgttacgtggtacggacggtacgtaccttacccgtcggtacggtccgggaccggttccgttacgggttcccgtagggtactacgggtacggtacccggg

SEQ ID NO: 170490 - DNA, 590 bp, Homo sapiens
  misc_feature: GYAE6OF02HELHR.15.87.H10.1.454.CMB.1.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
  modified_base (462)..(462): a, c, t, g, unknown or other
  misc_feature (462)..(462): n is a, c, g, or t
tcagtctacgtagccacgaccggtgctcgatttagcagtactgcgttgggtttggggctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcacgcctctggattcattctttaattagtttttggatgactgggtccnccagggtccaggggagggctgggaggtgggnggccgaacanaaagcaagataggaagtggaagaaatactatgtaggactctggtgaacgggcgatccaccatctaccagacganaaccgcaaagtaacttactagtatctgaactaatacgaacncgacctagaggacggacggaaggacagtcggtctgtacgtacgttacgtagtcgcggtagtcttaacccttcgtccgtggggtacccggcgtttacgggtttcccaccgggtctagtacggtaccggg

SEQ ID NO: 170491 - DNA, 836 bp, Homo sapiens
  misc_feature: GYAE6OF02FN30E.15.87.H10.1.454.CMB.1.raw
  modified_base (118)..(118): a, c, t, g, unknown or other
  misc_feature (118)..(118): n is a, c, g, or t
  modified_base (581)..(581): a, c, t, g, unknown or other
  misc_feature (581)..(581): n is a, c, g, or t
  modified_base (636)..(636): a, c, t, g, unknown or other
  misc_feature (636)..(636): n is a, c, g, or t
tcagtctacgtagccacgaccggtgctcgatttagcagtactgcgttgggtttgggggctcagagaggagccttagccctggactccaaggcctttccacttggtgatcagcactgancacagagactcaccatggaattgggactgagcgttgggttttccttgttgtcttattttagaggtgtccagtgtggaggttgcgtaggttgggtggtagtcgggtagggggaggtcgtttgggtacccgtaaccgggttcgggggggttccccttaggtaaggtaccgttccttccggttggtacggacctacggtccgtcggtacggtacttccgtaattttaccttttaaagttttagggttttttaacggaacgttccgggttaacccggttccgggggttccccgaccggggttaccgggggttacggaacggggggtaacggggtcggttacgggggtacgggttcggggtaccgtaacccgaaagtaaacgtaacgaagaaggtagacggtaagacgaaagtaatacgttgacggttagaccttggtaggtaacgggacggtccgtatacccacgtnaccgtacgaaacgtacacgaacgtaacctaagtaaccttgtactagtcacgttanacgtaacacgtacgacgtagacggtacgggaagtagacggtagtacggttctttacgttacggttaacgttacggtcgggtaccggaaggtaaccggttacctacccgggttaccgttccggggtcccgggtaacccgggtttccggttaaacccgggttacccggtcggttaacgggtcggttaaccgggttcccgggg

SEQ ID NO: 170492 - DNA, 334 bp, Homo sapiens
  misc_feature: GYAE6OF01C2P14.52.83.H06.1.454.CMB.1.raw
  modified_base (328)..(334): a, c, t, g, unknown or other
  misc_feature (328)..(334): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgccccatcccgggaggagatgaccaagaaccaggtcagcctgacctgcctggtcaaaggactacttccatacgatcgcgagcggctggcaaggcgcatagnnnnnnn

SEQ ID NO: 170493 - DNA, 337 bp, Homo sapiens
  misc_feature: GYAE6OF01E0EB2.52.83.H06.1.454.CMB.1.raw
  modified_base (330)..(337): a, c, t, g, unknown or other
  misc_feature (330)..(337): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggagagatgaccaagaaccaggtcagcctgacctgcctggtcaaggactacttcctatacgatcgctgagcgggctggcaaggcgcatagnnnnnnnn

SEQ ID NO: 170494 - DNA, 383 bp, Homo sapiens
  misc_feature: GYAE6OF01DIVCU.52.83.H06.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (365)..(383): a, c, t, g, unknown or other
  misc_feature (365)..(383): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtggacaaggtctaccaacaacgccctcccnccgacccccaatcgaanaaaaccatactaccaaagaccaaaggccacgccccgaagaaccacacggtacgtaccaccctcgaccccccagtcccgggagagacgtacgaaccaacgaaccaggtcacgcctcgacctgcctaggtccaaggtctacttctcgactgcgcgtgacggtcggcgtaggccaaggcgcagtgnnnnnnnnnnnnnnnnnnn

SEQ ID NO: 170495 - DNA, 338 bp, Homo sapiens
  misc_feature: GYAE6OF01CZ1UV.52.83.H06.1.454.CMB.1.raw
  modified_base (330)..(338): a, c, t, g, unknown or other
  misc_feature (330)..(338): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacaggtgtacaccctgcccccatcccgggagagatgaccaagaaccaggtcagcctgacctgcctggtcaaggactacttcctaatacgatcgctgagcgggctggcaaggcgcatagnnnnnnnnn

SEQ ID NO: 170496 - DNA, 338 bp, Homo sapiens
  misc_feature: GYAE6OF01AKFBG.52.83.H06.1.454.CMB.1.raw
  modified_base (325)..(325): a, c, t, g, unknown or other
  misc_feature (325)..(325): n is a, c, g, or t
  modified_base (331)..(338): a, c, t, g, unknown or other
  misc_feature (331)..(338): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaggactacttcctcgtactgcgctgagcgggctggcaaggcncatagnnnnnnnn

SEQ ID NO: 170497 - DNA, 334 bp, Homo sapiens
  misc_feature: GYAE6OF01AI4DN.52.83.H06.1.454.CMB.1.raw
  modified_base (323)..(323): a, c, t, g, unknown or other
  misc_feature (323)..(323): n is a, c, g, or t
  modified_base (329)..(334): a, c, t, g, unknown or other
  misc_feature (329)..(334): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggagagatgaccaagaaccaggtcagcctgacctgcctggtcaaggactacttccatacgatcgctgagcgggctggcaaggcncatagnnnnnn

SEQ ID NO: 170498 - DNA, 333 bp, Homo sapiens
  misc_feature: GYAE6OF01CB9RX.52.83.H06.1.454.CMB.1.raw
  modified_base (328)..(333): a, c, t, g, unknown or other
  misc_feature (328)..(333): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctgctcaaggctactcctatacgatcgctgagcggctggcaaggcgcatagnnnnnn

SEQ ID NO: 170499 - DNA, 343 bp, Homo sapiens
  misc_feature: GYAE6OF01CSJNA.52.83.H06.1.454.CMB.1.raw
  modified_base (335)..(343): a, c, t, g, unknown or other
  misc_feature (335)..(343): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccacgcccccatcgaagaaaaccatctccaaagccaaagggcagccccgagaaccacaggtgtacaccctgcccccatcccgggagagactgaccaagaaccaggtcagcctgacctgcctaggtcaaggactacgttcctatacgatcgctgagcggctggcaaggcgcagtagnnnnnnnnn

SEQ ID NO: 170500 - DNA, 349 bp, Homo sapiens
  misc_feature: GYAE6OF01E1L60.52.83.H06.1.454.CMB.1.raw
  modified_base (340)..(349): a, c, t, g, unknown or other
  misc_feature (340)..(349): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctaccaacaaagccctcccagcccccatcgaagaaaaccatctaccaaagccaaagggcacgccccgaagaaccacaggtgtacaccctcgcccccagtcccgggagagatcgaccaagaaccaggtcagcctgacctgcctggtcaaggactacttcatacgatcgctggagcggggctggcgaaggcgacatagnnnnnnnnnn

SEQ ID NO: 170501 - DNA, 460 bp, Homo sapiens
  misc_feature: GYAE6OF01ACDDW.52.83.H06.1.454.CMB.1.raw
  modified_base (180)..(180): a, c, t, g, unknown or other
  misc_feature (180)..(180): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (407)..(413): a, c, t, g, unknown or other
  misc_feature (407)..(413): n is a, c, g, or t
  modified_base (415)..(460): a, c, t, g, unknown or other
  misc_feature (415)..(460): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaagccctcccagcccccatcgaagaaaccntccaccaaagccaaaagggccacgccccgaanaaccanaggtntaccacccctggcccccccagtacccgggaggaacactacgaaccctaaggaaccaggtacacgcccttgaacccgtggcccgtagggtaacaaacggtaccttaccgtttacctaagtaccggattcccggacgttacggaacggccggggctacgggacggaaaccgggcaccgtaagaggnnnnnnngnnnnnnnnnnnnnnnnnnnnnnnnnnnnnnnnnnnnnnnnnnnnnn

SEQ ID NO: 170502 - DNA, 335 bp, Homo sapiens
  misc_feature: GYAE6OF02HYICF.52.83.H06.1.454.CMB.1.raw
  modified_base (330)..(335): a, c, t, g, unknown or other
  misc_feature (330)..(335): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacaggtgtacaccctgcccccatcccgggaggagatgaccaagaaccaggtcagcctgacctgcctggtcaaggactacttcctatacgatcgctgagcgggctggcaaggcgcatagnnnnnn

SEQ ID NO: 170503 - DNA, 334 bp, Homo sapiens
  misc_feature: GYAE6OF02HX8BN.52.83.H06.1.454.CMB.1.raw
  modified_base (329)..(334): a, c, t, g, unknown or other
  misc_feature (329)..(334): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacaggtgtacaccctgcccccatcccgggaggagatgaccaagaaccaggtcagcctgacctgcctggtcaaggctacttcctcgtactgcgctgagcgggctggcaaggcgcatagnnnnnn

SEQ ID NO: 170504 - DNA, 333 bp, Homo sapiens
  misc_feature: GYAE6OF02GEF1B.52.83.H06.1.454.CMB.1.raw
  modified_base (328)..(333): a, c, t, g, unknown or other
  misc_feature (328)..(333): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacaggtgtacaccctgccccatcccgggaggagatgaccaagaaccaggtcagcctgacctgcctggtcaaggactacttcctatacgatcgctgagcggctggcaaggcgcatagnnnnnn

SEQ ID NO: 170505 - DNA, 334 bp, Homo sapiens
  misc_feature: GYAE6OF02IOMO5.52.83.H06.1.454.CMB.1.raw
  modified_base (327)..(334): a, c, t, g, unknown or other
  misc_feature (327)..(334): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgccccatcccgggagagatgaccaagaaccaggtcagcctgacctgcctggtcaaggctactcctatacgatcgctgagcgggctggcaaggcgcatagnnnnnnnn

SEQ ID NO: 170506 - DNA, 335 bp, Homo sapiens
  misc_feature: GYAE6OF02H95PD.52.83.H06.1.454.CMB.1.raw
  modified_base (326)..(335): a, c, t, g, unknown or other
  misc_feature (326)..(335): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctccagcccccatcgagaaaccatctccaaagccaaagggcagccccgagaaccacaggtgtacaccctgcccccatcccgggagagatgaccaataaccaggtcagcctgacctgcctggtcaaggactacttccatacgatcgctgagcggctggcaaggcgcatagnnnnnnnnnn

SEQ ID NO: 170507 - DNA, 338 bp, Homo sapiens
  misc_feature: GYAE6OF02FQU3V.52.83.H06.1.454.CMB.1.raw
  modified_base (329)..(338): a, c, t, g, unknown or other
  misc_feature (329)..(338): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagccaaagggcagccccgagaaccacaggtgtacaccctgcccccatcccgggaggagatgaccaagaaccaggtcagcctgacctgcctggtcaaggactacttcctatacgatcgctgagcggctggcaaggcgcatagnnnnnnnnnn

SEQ ID NO: 170508 - DNA, 339 bp, Homo sapiens
  misc_feature: GYAE6OF02GGFTQ.52.83.H06.1.454.CMB.1.raw
  modified_base (330)..(339): a, c, t, g, unknown or other
  misc_feature (330)..(339): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaggctactcctcgtactgcgctggagcgggctggcaaggcgcatagnnnnnnnnnn

SEQ ID NO: 170509 - DNA, 345 bp, Homo sapiens
  misc_feature: GYAE6OF02FYJ6N.52.83.H06.1.454.CMB.1.raw
  modified_base (324)..(324): a, c, t, g, unknown or other
  misc_feature (324)..(324): n is a, c, g, or t
  modified_base (330)..(332): a, c, t, g, unknown or other
  misc_feature (330)..(332): n is a, c, g, or t
  modified_base (334)..(345): a, c, t, g, unknown or other
  misc_feature (334)..(345): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggagacgatgaccaagaaccaggtcagcctgacctgcctggtcaaggctacttccatacgatcgctgacgcgggctggcaaggcncatagnnntnnnnnnnnnnnn

SEQ ID NO: 170510 - DNA, 341 bp, Homo sapiens
  misc_feature: GYAE6OF02F4XMR.52.83.H06.1.454.CMB.1.raw
  modified_base (334)..(341): a, c, t, g, unknown or other
  misc_feature (334)..(341): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccagtcccgggaggagatgaaccaagaaccaggtcagcctgacctgcctggtcaaggactacttccatacgatcgctgagcgggctggcaaggcgacagtagnnnnnnnn

SEQ ID NO: 170511 - DNA, 363 bp, Homo sapiens
  misc_feature: GYAE6OF02F0D7E.52.83.H06.1.454.CMB.1.raw
  modified_base (350)..(350): a, c, t, g, unknown or other
  misc_feature (350)..(350): n is a, c, g, or t
  modified_base (355)..(363): a, c, t, g, unknown or other
  misc_feature (355)..(363): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaccatctccaaagaccaaagggcacgccccgagaaccacgaggtcgtaccaccctcgccccccacgtccccgggaggagatcgaaccaagaacccagggaccagccctggacctgcctggtacaaggacctacttcctatacgatccgctggacgcgggctcggcaagggcganatagnnnnnnnnn

SEQ ID NO: 170512 - DNA, 345 bp, Homo sapiens
  misc_feature: GYAE6OF02HDF4X.52.83.H06.1.454.CMB.1.raw
  modified_base (335)..(345): a, c, t, g, unknown or other
  misc_feature (335)..(345): n is a, c, g, or t
tcagcgcagtacgacacgaccggtgctcgatttagatcacgtgcgtcgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccagtccccgggaggagatcgaaccaagaaccaggtcagcctgacctgcctggtacaaggactactcctatacgatcgctgagcgggctggcaaggcgcatagnnnnnnnnnnn

SEQ ID NO: 170513 - DNA, 449 bp, Homo sapiens
  misc_feature: GYAE6OF02HRUXX.35.77.G11.1.454.CMB.1.raw
  modified_base (440)..(449): a, c, t, g, unknown or other
  misc_feature (440)..(449): n is a, c, g, or t
tcagtacagatcgtcacgaccggtgctcgatttagctagtcactcaagggaaaggggctggagtgggtgacagttatatcagatgatggaagtaatgaatactatgcagactccgtgaagggccgattcaccatctccagagacaattccaagaacacggtgtatctgcaaatgaatagcctgagagctgaggacacggctgtgtattactgtgctaaaagaacgaatagcagcagccaattatattactactactattacgtatggacgtctggggccaagggaccacggtcaccgtctcctcagcctccaccaagggcccatcggtcttccccctggcaccctcctccaagacgcacctctgggggcacagcggccctgggctgcctggtcaaggctacttccacgatctgtactgagcgggctggcaagcgcatagnnnnnnnnnn

SEQ ID NO: 170514 - DNA, 465 bp, Homo sapiens
  misc_feature: GYAE6OF02JF8JR.35.77.G11.1.454.CMB.1.raw
  modified_base (442)..(442): a, c, t, g, unknown or other
  misc_feature (442)..(442): n is a, c, g, or t
  modified_base (444)..(465): a, c, t, g, unknown or other
  misc_feature (444)..(465): n is a, c, g, or t
tcagtacagatcgtcacgaccggtgctcgatttagctagtcactcaagggaaaggggctggagtgggtgacagttatatcagatgatggaagtaatgaatactatgcagactccgtgaagggccgattcaccatctccagagacaattccaagaacacggtgtatctgcaaatgaatagcctgagagctgaggacacggctgtgtattactgtgctaaagaacgaatagcagcagccaatttatattactactactattacggtatggacgtctggggccaagggaccacggtcaccgtctcctcagcctccaccaagggcccatcggtcttcccctcggcaccctcctccaacgagcacctctggggcacagccggccctgggctgcctggtcaaggctacttccacgatctgtactgagcggctggctaaggcgcatagngnnnnnnnnnnnnnnnnnnnnnn

SEQ ID NO: 170515 - DNA, 510 bp, Homo sapiens
  misc_feature: GYAE6OF02I179V.35.77.G11.1.454.CMB.1.raw
  modified_base (332)..(332): a, c, t, g, unknown or other
  misc_feature (332)..(332): n is a, c, g, or t
  modified_base (487)..(489): a, c, t, g, unknown or other
  misc_feature (487)..(489): n is a, c, g, or t
  modified_base (492)..(510): a, c, t, g, unknown or other
  misc_feature (492)..(510): n is a, c, g, or t
tcagtacagatcgtcacgaccggtgctcgatttagctagtcactcaagggaaaggggctggagtgggtgacagttatatcagatgatggaagtaatgaatactatgcagactccgtgaagggccgattcaccatctccagagacaattccaagaacacggtgtatctgcaaatgaatagcctgagagctgaggacacggctgtgttattactgtgactaaagaacgaatagcagcagcctaatttatattactactactattacgtatggacgtcgtggggccaacgggaccacggtctaccgtctcctcagccctccaccaacgggccccngtccggtcccttcccccgtggccctaccctccctccgaacgcgccaccctcgtcgggggcacgacgccggcccgtcgggctcggcctggtaccaaggccttacgtccacgtactcgtcgtacgtgacggcggtcgtcggaccaggcctcgatagnnncgnnnnnnnnnnnnnnnnnnn

SEQ ID NO: 170516 - DNA, 818 bp, Homo sapiens
  misc_feature: GYAE6OF02IDE6B.35.77.G11.1.454.CMB.1.raw
  modified_base (134)..(134): a, c, t, g, unknown or other
  misc_feature (134)..(134): n is a, c, g, or t
  modified_base (424)..(424): a, c, t, g, unknown or other
  misc_feature (424)..(424): n is a, c, g, or t
  modified_base (782)..(782): a, c, t, g, unknown or other
  misc_feature (782)..(782): n is a, c, g, or t
  modified_base (784)..(790): a, c, t, g, unknown or other
  misc_feature (784)..(790): n is a, c, g, or t
  modified_base (792)..(793): a, c, t, g, unknown or other
  misc_feature (792)..(793): n is a, c, g, or t
  modified_base (795)..(798): a, c, t, g, unknown or other
  misc_feature (795)..(798): n is a, c, g, or t
  modified_base (801)..(802): a, c, t, g, unknown or other
  misc_feature (801)..(802): n is a, c, g, or t
  modified_base (804)..(808): a, c, t, g, unknown or other
  misc_feature (804)..(808): n is a, c, g, or t
  modified_base (810)..(818): a, c, t, g, unknown or other
  misc_feature (810)..(818): n is a, c, g, or t
tcagtacagatcgtcacgaccggtgctcgatttagctagtcactcaagggaaaggggctggagtgggtgacagttatatcagatgatggaagtaatgaatactatgcagactccgtgaaggccgattcacatcncagagacaattaccaagacacggtgtatctgcaaatgaatacgccgtagacgagcgtaggaacggaccgaacgggtccttaggttagtttaaacgttaacgttggttaaggaccggaaaaggtaaacgggtaccggaaggttacgggggaacccgtccccgtttaaacccccccggggagttacggaacggacccggtaaacggtccggggggtaccccggaagggggtaccccgtaaccccccggttggggttacccggtacccccggtcctttaccggtttaaccccncccggtacccccgtaaaccccggtaaaccccggaaccccggggttaaccccgtaaccggttttccccggttcccccgtttacccccccggggacggttacccccttaaaccccccgtccccgttaacccggaaaacgcccggtaccccgttacccggtacgggttcccgggggaaaccacccgggcgggtcccccgggtcggttaccggggcccgttcggtcccgggtacggttaaaccgggaacccggttaaccttacccgttaaacccgacgtttaaccgtccggttagtaacccggttaggccggggttccggtaccggtacgggaaccgacgggtccaaacggttcaaggtcgngnnnnnnncnngnnnngcnngnnnnngnnnnnnnnn

SEQ ID NO: 170517 - DNA, 492 bp, Homo sapiens
  misc_feature: GYAE6OF01CP3EU.27.78.H01.1.454.CMB.1.raw
  modified_base (425)..(425): a, c, t, g, unknown or other
  misc_feature (425)..(425): n is a, c, g, or t
tcagagcgtcgtctcacgaccggtgctcgatttagtgtgagtagtttgggtttgggatgagcaaaactgacaagtcaaggcaggaagatgttgccatcacaactcattgggttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaattatactgtcatcagagtactactttacncagtgatcacttcggccaagggacacgactaggagaattaaacgaactgtgctgcacatctgtcttc

SEQ ID NO: 170518 - DNA, 490 bp, Homo sapiens
  misc_feature: GYAE6OF01C4P94.27.78.H01.1.454.CMB.1.raw
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacactatttcaccctcaccatcaatagcctggaagctgaagatgctgcaacttatactgtcatcagatactactttacctcaagtnatcaccttcggccaagggcacgactggagataacgatgngctgcacatctgtctc

SEQ ID NO: 170519 - DNA, 494 bp, Homo sapiens
  misc_feature: GYAE6OF01BOUW2.27.78.H01.1.454.CMB.1.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccagggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctnatcaagtatgcttcccagtccttcncacggggtcccctcgaggttcagtggcagtggatctggacacatttccaccctcaccatcaatagcctggaanctagaagatgctgacaattattactgtcatcagatactactttaccnaacgtnatcacttcggacaagggcacgactggacattaaacagtgtggctgcactatctgtcttc

SEQ ID NO: 170520 - DNA, 498 bp, Homo sapiens
  misc_feature: GYAE6OF01AUPAP.27.78.H01.1.454.CMB.1.raw
  modified_base (387)..(387): a, c, t, g, unknown or other
  misc_feature (387)..(387): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaacnctgaagatgctgacaacttattactgtcatcagagtactactttaccnaagtnatcaccttcggccaagggacacgactggagattaaacggactgtgctgcacntctgtc

SEQ ID NO: 170521 - DNA, 513 bp, Homo sapiens
  misc_feature: GYAE6OF01D3816.27.78.H01.1.454.CMB.1.raw
  modified_base (208)..(208): a, c, t, g, unknown or other
  misc_feature (208)..(208): n is a, c, g, or t
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
tcagagcgtcgtctcacgaccggtgctcgatttagtgtgagtagtttgggttgggggcatcgagcaaaactgaccgtaagtcaaggcaggaagatgttgccattcacaacttcaattgggtttcctggctgctctgggttccagcctccaacgggtgaaattgtgctgacctcagtctccagactttcagtctgtgactccaaaaggngaaagtcaccatcacctgccgggccagtcagagcgttggtagtagcttacactggtaccagcagaagccaggtcagtctccaaagctcctcatcaagtatgcttcccagtccttctcagggtcccctgagttcagtgcagtgatctgggacacatttcaccctnaccatcaatagccctggaagctagaagatgctgctaacttattactgtcatcagtagtactactttacctcaagttgatctaccgttcggaccaagggcacgacgtaggatattaaacgactgtgctgacacntcgtgtcc

SEQ ID NO: 170522 - DNA, 493 bp, Homo sapiens
  misc_feature: GYAE6OF01EPLYN.27.78.H01.1.454.CMB.1.raw
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgctaacttattactgtcatcagagtactactttaccntaagtgatcaccttggccaagggacacgactgganataacgactgtgctgcacntctgtc

SEQ ID NO: 170523 - DNA, 510 bp, Homo sapiens
  misc_feature: GYAE6OF01CCMGL.27.78.H01.1.454.CMB.1.raw
  modified_base (229)..(229): a, c, t, g, unknown or other
  misc_feature (229)..(229): n is a, c, g, or t
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcaggtctccagactttcagtctgtgactccaaaggngaaagtcaccatcacctgccgggccagtcagagcgttggtagtagcttacactggtaccagcagaacgccaggtcagtctccaaagctcctcatcaagtatgcttccagtccttctcacgggtcccctcgaggttcagtggcagtggatctgggacacatttccaccctcaccatcaatgcctggaagctgaagntgctgcaacttntactgtcatcagtagtactactttacctnaagtgattctaccttcggaccaagggacacgatgganagtaaacg

SEQ ID NO: 170524 - DNA, 550 bp, Homo sapiens
  misc_feature: GYAE6OF01D0MQE.27.78.H01.1.454.CMB.1.raw
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacgatttcaccctcaccatcaaatagcctggaagctgaagatgctgactaacttattactgtcatcaagagttactactttaccnctaagtgacttccaaccttcgggacccaaagggaccaacggactagggaacgtaattaaaaccggaacttggtacggacctaggacccacccgaattccttggttcctttacccg

SEQ ID NO: 170525 - DNA, 498 bp, Homo sapiens
  misc_feature: GYAE6OF01EAHDX.27.78.H01.1.454.CMB.1.raw
  modified_base (385)..(385): a, c, t, g, unknown or other
  misc_feature (385)..(385): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctagaagatgctgcaacttattactgtcatcagagtactactttacctcaagtgactcaccttcggaccaaggacacgactggagtataaacgactgtgctgcacntctgtcc

SEQ ID NO: 170526 - DNA, 510 bp, Homo sapiens
  misc_feature: GYAE6OF01EAFII.27.78.H01.1.454.CMB.1.raw
  modified_base (503)..(503): a, c, t, g, unknown or other
  misc_feature (503)..(503): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctgaggttcagtggcagtggatcgtgggacactatttccaccctcaccatcaatacgcctggaagctagaagatgctgactaacttattactgtacatcagagtactactttacctcaagtgatcaccttcggccaaggcacgactgganataaacg

SEQ ID NO: 170527 - DNA, 499 bp, Homo sapiens
  misc_feature: GYAE6OF01DU3LI.27.78.H01.1.454.CMB.1.raw
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttccaccctcaccatcaaatacgcctggaagctgaagatgctgctaacttattactgtcatcagtatactactttactcaagtgatcacttcggccaaggcacgactaggagattaaacgacttgngctgccacatctgtcttc

SEQ ID NO: 170528 - DNA, 512 bp, Homo sapiens
  misc_feature: GYAE6OF01APCT6.27.78.H01.1.454.CMB.1.raw
tcagagcgtcgtctcacgaccggtgctcgatttagtgtgagtagtttgggtttggggatcttaaaagaggttctttctctgggatgtggtatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctgggaagctgaagatgctgctaacttattactgtcatcatagtactacttacctcaagtgatcaccttcggaccaagggacacgactaggatattaacgaac

SEQ ID NO: 170529 - DNA, 652 bp, Homo sapiens
  misc_feature: GYAE6OF01CL1PL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtactcgtcctccacgtccttctcggtaccgggtcccctcggtacggttcgtaggtcggacgtaggtaggtacgttcggtacgggaacacttacttacctacccttaccacctactactaacgtacgtaccgtaaggaacgtccgtaaggaaacgtacgtacgtacgtacgtaaccttaaacttttacttaacgttacgtacctaacgtacgtaacgttaacgttaacctttaacctttaccgtaacgttacgtaacgtacctaccgttaccgtaccggacggaacgacgacgtacggtacgaacgttaaacgtaacgtagtcgggtacgtacgacgtacctactactctcgttcttaccg

SEQ ID NO: 170530 - DNA, 510 bp, Homo sapiens
  misc_feature: GYAE6OF01AQNBJ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcagggtccctcgaggttcagtgcagtggatctgggacacatttcacctcaccatcaatagcctggaagctgaagatgctgcaacttatactgtcatcagatactactttacctcaagtgatcacccttcggaccaagggaccacggactgggagtagttaaaaccgg

SEQ ID NO: 170531 - DNA, 533 bp, Homo sapiens
  misc_feature: GYAE6OF01ETB95.27.78.H01.1.454.CMB.1.raw
  modified_base (417)..(417): a, c, t, g, unknown or other
  misc_feature (417)..(417): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacgggtcccctcgaggttccagtggcagtgatctgggacactatttccaccctcaccatcaatagcctggaanctagaagatgctgctaacttattactgtacatcaagtacgtacttacctttaccataagttcgaattcacccttcggacccaaggggtaccacggactgggataagttaaaaccgg

SEQ ID NO: 170532 - DNA, 512 bp, Homo sapiens
  misc_feature: GYAE6OF01EBAQ5.27.78.H01.1.454.CMB.1.raw
  modified_base (420)..(420): a, c, t, g, unknown or other
  misc_feature (420)..(420): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcacccatcaatagcctaggaanctgaagatgctgcaacttattactgtcatcagagtactactttaccnaagtgatcaccttcggaccaagggacaacgactggagataaaacg

SEQ ID NO: 170533 - DNA, 520 bp, Homo sapiens
  misc_feature: GYAE6OF01ECAQC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacactatttccaccctcaccatcaatagcctggaagctagaagatgctagactaacttattactgtcatcagtagtactactttacctataagtgatccacgttcggaccgaaggacacgactaggagtaacttaaacgacttgagtctacgtccactatctgtcttac

SEQ ID NO: 170534 - DNA, 529 bp, Homo sapiens
  misc_feature: GYAE6OF01ARIOD.27.78.H01.1.454.CMB.1.raw
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctggacacatttcaccctcaccatcaatgcctggaagctgaagatgctgctaacttnttaactgtcatcaagtacgtactactttacctanaagtgattcaccttcggaccaagggtaccacgacgtaggaacgtattaaacggaactggtaggccttaggaccaacctatccttgttccttaccg

SEQ ID NO: 170535 - DNA, 505 bp, Homo sapiens
  misc_feature: GYAE6OF01C5Y38.27.78.H01.1.454.CMB.1.raw
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (489)..(489): a, c, t, g, unknown or other
  misc_feature (489)..(489): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatcgtgggacacatttcaccctcaccatcaatacgcctaggaanctagaagatgctgcaactttattactgtcatcagagtactactttaccntaagtnactctaccgtcggaccaaggacacgatggaatattaaacgactggngctgcaccatctgtcc

SEQ ID NO: 170536 - DNA, 130 bp, Homo sapiens
  misc_feature: GYAE6OF01DROXT.27.78.H01.1.454.CMB.1.raw
  modified_base (130)..(130): a, c, t, g, unknown or other
  misc_feature (130)..(130): n is a, c, g, or t
tcagagcgtcgtctcacgaccggtgctcgatttagtgtgagtagtttgggtttgggcacagcggccctgggctgcctggtcaaggactacttccagacgacgctctgagcgggctggcaaggcgcatagn

SEQ ID NO: 170537 - DNA, 518 bp, Homo sapiens
  misc_feature: GYAE6OF01DUFT3.27.78.H01.1.454.CMB.1.raw
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctagaagatgctgacaacttattactgtcatcagagtactactttacctnaagtgactcaccgttcggaccaagggaccacgacgtaggaagtaattaaacggactgtaggctacggcaaccattctgtcttac

SEQ ID NO: 170538 - DNA, 492 bp, Homo sapiens
  misc_feature: GYAE6OF01EKFNR.27.78.H01.1.454.CMB.1.raw
  modified_base (428)..(428): a, c, t, g, unknown or other
  misc_feature (428)..(428): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacncaagtgatcacttcggccaagggcacgactgganagttaaacgactgngctgcacatctgtctc

SEQ ID NO: 170539 - DNA, 513 bp, Homo sapiens
  misc_feature: GYAE6OF01A9RKY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtacatcagagtactacttacctcaagtgatccaccgttcgaccaacgggacacgactggaagattaaaacg

SEQ ID NO: 170540 - DNA, 502 bp, Homo sapiens
  misc_feature: GYAE6OF01CM56S.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctagaagatgctgcaacttattactgtcatcagagtacttactttacctcaagtgatcaccttcggaccaagggacacgactaggagattaaacgactgtgctgcaccatctgtcc

SEQ ID NO: 170541 - DNA, 498 bp, Homo sapiens
  misc_feature: GYAE6OF01C4TW9.27.78.H01.1.454.CMB.1.raw
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttatactgtcatcagagtactattacctcaagtgaattcaaccttcggaccaagggacacgactggagattaaacgactgnggctgacacatcngtcc

SEQ ID NO: 170542 - DNA, 495 bp, Homo sapiens
  misc_feature: GYAE6OF01BJ6UH.27.78.H01.1.454.CMB.1.raw
  modified_base (428)..(428): a, c, t, g, unknown or other
  misc_feature (428)..(428): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagatactactttaccncaagtgatcaccttcggaccaagggacacgactgggagattaaacgactgngcngcacatctgtctc

SEQ ID NO: 170543 - DNA, 501 bp, Homo sapiens
  misc_feature: GYAE6OF01AIXBZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttaccactaagtgattcaccttcggaccaagggacacgactaggagattaaacgactgtggctgcacatctgtcttac

SEQ ID NO: 170544 - DNA, 528 bp, Homo sapiens
  misc_feature: GYAE6OF01EBYCP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcagggtcccctgaggttcagtggcagtggatcgtgggacactatttccaccctcaccatcaatagcctggaagctagaagatgctgactaacttattactgtcatcagtagtactactttacctcaagtgacttctaccttcggaccgaagggaccacgacgtaggaacgaacttaaacgaacgtggtggactacgaccaccatcttgtccttacg

SEQ ID NO: 170545 - DNA, 498 bp, Homo sapiens
  misc_feature: GYAE6OF01B7IQ3.27.78.H01.1.454.CMB.1.raw
  modified_base (383)..(383): a, c, t, g, unknown or other
  misc_feature (383)..(383): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggaccaagggacacgactggagattaaacgaatgtgctgcaccatctgtcttc

SEQ ID NO: 170546 - DNA, 495 bp, Homo sapiens
  misc_feature: GYAE6OF01B3V8M.27.78.H01.1.454.CMB.1.raw
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtgatctggacacatttcaccctcaccatcaatagcctggaagctgaagatgctgcaacttattactgtcatcagtagtactactttacctcaagtgatcaccttcggccaagggcaacgactggagattaaacgactgnggctgcacatctgtctcg

SEQ ID NO: 170547 - DNA, 498 bp, Homo sapiens
  misc_feature: GYAE6OF01CQROD.27.78.H01.1.454.CMB.1.raw
  modified_base (492)..(492): a, c, t, g, unknown or other
  misc_feature (492)..(492): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggttcccctcgaggttcagtggcagtggatctgggacacatttcaccctcaccatcaatagcctggaagctagaagatgctgcaacttattactgtcatcagagtactactttacctcaagtgatcaccttcggaccaagggcacgactggagattaaacgactgtagctcgcaccntctgtc

SEQ ID NO: 170548 - DNA, 511 bp, Homo sapiens
  misc_feature: GYAE6OF01CXP18.27.78.H01.1.454.CMB.1.raw
  modified_base (313)..(313): a, c, t, g, unknown or other
  misc_feature (313)..(313): n is a, c, g, or t
  modified_base (397)..(397): a, c, t, g, unknown or other
  misc_feature (397)..(397): n is a, c, g, or t
  modified_base (507)..(507): a, c, t, g, unknown or other
  misc_feature (507)..(507): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctcaaagctcctcatcaagtatgcttcccagtccttcnctacggggtcccctgaggttcaggtggcagtgatctgggacacatttcaccctcaaccatcaatacgcctaggaagctagaagntgctgacaacttattactgtcatcagagttactactttacctcaagtgatcgaccttcggaccaaggacacgactagggacaattaaacgatgtagctgacacactcgtnttcc

SEQ ID NO: 170549 - DNA, 512 bp, Homo sapiens
  misc_feature: GYAE6OF01D834Y.27.78.H01.1.454.CMB.1.raw
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcacccatacaatacgcctggaanctagaagatgctgctaacttattactgtcatcagtagtactactttacctnaagtnatcaccttcggaccaagggcacgatggagataaacg

SEQ ID NO: 170550 - DNA, 518 bp, Homo sapiens
  misc_feature: GYAE6OF01DIOA8.27.78.H01.1.454.CMB.1.raw
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacggggtcccctcgaggttcagtggcaggtggatctgggacacatttccaccctcaccatacaatagcctggaagctagaagatgctgctaacttattactgtcatcagtagtaccttacttacctntaagtnatcacccttcggaccaagggtacacgataggagtataaacg

SEQ ID NO: 170551 - DNA, 501 bp, Homo sapiens
  misc_feature: GYAE6OF01A6WF0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctggacacatttcaccctcaccatcaatagcctggaagctgaagatgctgactaacttattactgtcatcaagtatactactttacctacaagtgtatcaccttcgaccaagggacacgactaggagacttaaacgactgtagctgcacatctgtctc

SEQ ID NO: 170552 - DNA, 516 bp, Homo sapiens
  misc_feature: GYAE6OF01BIE71.27.78.H01.1.454.CMB.1.raw
  modified_base (196)..(196): a, c, t, g, unknown or other
  misc_feature (196)..(196): n is a, c, g, or t
  modified_base (450)..(450): a, c, t, g, unknown or other
  misc_feature (450)..(450): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttaggtagtagcttacactggtaaccagcagaagccaggtcagtctccaaagctcctcatcaagtatgccttcccagtccttctcaggggtcccctcgaggttcagtggcagtggatctgggacacactttccaccctcaccatcaatagcctggaagctagaagatagtctgactaacttattactgtacatcagagttactactttaccactaagtnatcaccttcggacaagggcacgactggagtattaaacgactcgtggctcgacaccatctgtcttac

SEQ ID NO: 170553 - DNA, 499 bp, Homo sapiens
  misc_feature: GYAE6OF01A8KPW.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctcaagtgatcaccttcggaccaagggcacgactaggagagttaaacgactgtaggctgcaccatctgtctac

SEQ ID NO: 170554 - DNA, 502 bp, Homo sapiens
  misc_feature: GYAE6OF01DTQKM.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggttgggggcatgagcaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatccacctgcccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatgcctggaagctgaaagatgctgcaacttattactgtcatcagagttactactttacctacaagttgatcaccttcggaccaaagggacacgactggagaattaaacgactgtgctgcacatctgtcc

SEQ ID NO: 170555 - DNA, 541 bp, Homo sapiens
  misc_feature: GYAE6OF01D3UH2.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcgacggggtcccctcggacggttcagtggcaggtggatcgtgggacactatttccaccctcacccatcaatacgcctaggaacgctagaagatgctgactaacttattactgtcatcagtacgtactactttacctacaagtgatcctaccttccgggaccaaacggggacaacggactaggaagtaattaaaaccgg

SEQ ID NO: 170556 - DNA, 496 bp, Homo sapiens
  misc_feature: GYAE6OF01AZWTV.27.78.H01.1.454.CMB.1.raw
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
  modified_base (478)..(478): a, c, t, g, unknown or other
  misc_feature (478)..(478): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttaccncaagtgatcaccttcggccaagggcacgactggagattaacgaactgnggctgcaccatctgtctc

SEQ ID NO: 170557 - DNA, 510 bp, Homo sapiens
  misc_feature: GYAE6OF01BR10W.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaagctagaagatgctgctaactttattaactgtcatcagagtactactttacctacaagtgtactctaccttcggaccaagggacacgactaggagtacttaaagaactgtgctgacacatctgtctac

SEQ ID NO: 170558 - DNA, 562 bp, Homo sapiens
  misc_feature: GYAE6OF01DB15Z.27.78.H01.1.454.CMB.1.raw
  modified_base (399)..(399): a, c, t, g, unknown or other
  misc_feature (399)..(399): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgcccgggccagtcagagcgttggtagtagcttacactggtaccagcagaagccaggtcagtctccaaagctcctcatcaagtatgcttcccagtcctctcacgggtcccctcgaggttcagtggcagtggatcgtgggacacgatttcaccctcaccatacaatagacctggaagctagaagntgctgctaacttattactgtcatcagagtactactttacctactaagtgaatctaaccttcggaccaaagggtaccaacggtacgtagggaaacgtaagtttaaaaccggaacgtttaggtacgggaccttacggacctaaccctattccgttcggtttaccc

SEQ ID NO: 170559 - DNA, 496 bp, Homo sapiens
  misc_feature: GYAE6OF01CH5PP.27.78.H01.1.454.CMB.1.raw
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgagttcagtggcagtggatctgggacacatttcaccctcaccatcaatacgcctggaagctagaagntgctgctaacttattactgtcatcagtatactactttacctcaagtgtatcaccttcggaccaaggacacgactggagattaacgactgtgctgcacatctgtctc

SEQ ID NO: 170560 - DNA, 499 bp, Homo sapiens
  misc_feature: GYAE6OF01DH8G4.27.78.H01.1.454.CMB.1.raw
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagacgtacttactttacctctaagtgatccaccttcggccaagggacacgactggagacttaaagactgnggcngcacatctgtctc

SEQ ID NO: 170561 - DNA, 498 bp, Homo sapiens
  misc_feature: GYAE6OF01DXOUQ.27.78.H01.1.454.CMB.1.raw
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctnaccatcaatagcctggaanctgaagatgctgacaacttattactgtcatcagatactactttaccncaagtgatcacttcggactaagggacacgactggagattaaacgactgtgctgcacntctgtcttc

SEQ ID NO: 170562 - DNA, 546 bp, Homo sapiens
  misc_feature: GYAE6OF01CJX1O.27.78.H01.1.454.CMB.1.raw
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaaagtntgccttcccagttccttccgtccacggggttcccctcgtaggttcaggtcggcagtggatcgtgggacactactttccaccctcaccatacaatacgcctaggaagctagaacgtatgctagactaacttattacngtacatcagtacgtacttacctttacctnaagtnacttcgaccgttcggaccgaagggacacggatagggaataacgttaaacgctggtacggctgacctacattcctgttccc

SEQ ID NO: 170563 - DNA, 519 bp, Homo sapiens
  misc_feature: GYAE6OF01DM8A1.27.78.H01.1.454.CMB.1.raw
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcaggtggatcgtgggacacatttccacccttcaccctatcaatacgcctggaagctagaacgatgctgactaacttattactgtcatcagtatactacttacctcaagtnatcaccttcggccaagggccacgactaggagtattaaacg

SEQ ID NO: 170564 - DNA, 499 bp, Homo sapiens
  misc_feature: GYAE6OF01EMLX5.27.78.H01.1.454.CMB.1.raw
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgctaacttnttactgtcatcagatactactttaccnaagtgattccaccttcggaccaagggacacgactagggagattaaacgactgtggctgcacatctgtctc

SEQ ID NO: 170565 - DNA, 506 bp, Homo sapiens
  misc_feature: GYAE6OF01AVUUX.27.78.H01.1.454.CMB.1.raw
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggttcccctgaggttcagtggcagtggatcgtgggacactatttccaccctcaccatcaatacgcctaggaagctagaagatgctgacaactttattactgtcatcagagtactactttactcaagtnatcaccttcgaccaagggacacgacnggacattaaacgactgnggctgacaccntctgtcc

SEQ ID NO: 170566 - DNA, 521 bp, Homo sapiens
  misc_feature: GYAE6OF01DP1LG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagagtgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcaggggtcccctcgagttcagtggcagtggatcgtgggacacatttccaccctcacccatcaaatagcctggaagctgaagatgctgctaacttattactgtcatcagtacgtactactttacctcaagtgatcacccttacggccaagggacacgactagggagtattaaaaccgg

SEQ ID NO: 170567 - DNA, 515 bp, Homo sapiens
  misc_feature: GYAE6OF01CLBBN.27.78.H01.1.454.CMB.1.raw
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccggcagaagccaggtcagtctccaaagctcctcatcaagtatgcttcccagtccttctcacggggtcccctgagttcagtggcagtggatcgtgggacactatttcaccctcaccatcaatagcctaggaagctagaagatgctgactaacttatactgtcatcagntactacttactcaagtgactcaccttcggaccaagggacacgactaggataagtaaacgacg

SEQ ID NO: 170568 - DNA, 567 bp, Homo sapiens
  misc_feature: GYAE6OF01B5YMC.27.78.H01.1.454.CMB.1.raw
  modified_base (335)..(335): a, c, t, g, unknown or other
  misc_feature (335)..(335): n is a, c, g, or t
tcagagcgtcgtctcacgaccggtgctcgatttagtgtgagtagtttgggtttggggaggtcttaaaagaggttctttctctgggagtgtggcatgagcaaaactgaccaagtcaaggccaggaagatgttgccatcacaactcattgggtttctgctgctctgggttccagcctccacggggtgaaattgtgctcgactcagtctccagactttcagtctgtgactccaaaggagaaagtcaccatacacctgccgggccagtcagagcgttggtagtagcttacactcggtaccagcagagccaggtcagtctccaaagctcctcatcaagtntgcttcccagttcccttctcgacggggtccccctcggacggttcaggtcggactaggtcggatcgtcggggacactacgtttccaccccttcaacccatacgaaatacgcctgggaagcttagaagagtgactgctaacttatactgtactatcagtagtactacttaccgtacaagtgtatccgaccttcggaccaacgggaccacggactcgggacgtagttaaaaccgg

SEQ ID NO: 170569 - DNA, 486 bp, Homo sapiens
  misc_feature: GYAE6OF01CSHGX.27.78.H01.1.454.CMB.1.raw
  modified_base (382)..(382): a, c, t, g, unknown or other
  misc_feature (382)..(382): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatcgtggacacattcaccctcaccatcaatagcctaggaanctagaagatgctagactaacttatactgtcatcagatactacttacnagtgntcacttcgcaaggacagactggagtataagactgngcngcacatctgtctac

SEQ ID NO: 170570 - DNA, 511 bp, Homo sapiens
  misc_feature: GYAE6OF01BSO5U.27.78.H01.1.454.CMB.1.raw
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacgggtcccctcgaggttcagtggcagtggatcgtgggacacatttcaccctcaccatcaatacgcctggaagctagaagatgctgactaacttattactgtcatcagtagtacttacttacctcaagtgacttcaccttcggaccaagggaccacgacgtggaagtacttaaacgactgngctcgcacatctgtntacc

SEQ ID NO: 170571 - DNA, 516 bp, Homo sapiens
  misc_feature: GYAE6OF01EKA54.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctaggaagctagaagatgctgactaacttattactgtctatcagtagtactactttacctctaagtgtactctaccttcggaccgaagggacacgtacgtaggaagacttaaacgacgtgtcgctgcacatctgtcttc

SEQ ID NO: 170572 - DNA, 543 bp, Homo sapiens
  misc_feature: GYAE6OF01BKF9U.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacgatttcaccctcacccatccaatacgcctaggaacgctagaagatgctgctaacttattactgtcatcagtacgtacttactttacctactaagtgtactcaccgttacggacccgtaagggaccacgacgtaggaagtaacgttaaacgacttggtaggtctacgtacacctatcgttcgtctttaccg

SEQ ID NO: 170573 - DNA, 499 bp, Homo sapiens
  misc_feature: GYAE6OF01EGP7A.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattcaccctcaccatcaatagcctggaagctagaagatgctgacaacttattactgtcatcagtagtactactttacctcaagtgatcaccttcggaccaagggacacgactggagattaaacgatgtgctgacaccatctgtc

SEQ ID NO: 170574 - DNA, 524 bp, Homo sapiens
  misc_feature: GYAE6OF01C1HEL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatacgcctggaagctgaagatgctgcaactttattactgtcatcaagagttacctactttacctactaagtgatccacctttccgggaccaagggaccacggactgggaagtacttaaacgaacttggtggctcgcaccatcctgtcttacc

SEQ ID NO: 170575 - DNA, 805 bp, Homo sapiens
  misc_feature: GYAE6OF01CA2KN.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtcccacgacgttcttacgtcgtcgtgtacgtacctaaacggaaaggaaagtaacaccactactaccctcgccgggaccgacgtacgacgaaggtcggttcggttaggtagtacgttacctaacgtacggttaccgaacgacgacgaaaggaccgacggtacgacgtacgtcctaaacggactcctccactactaacgtattacgccgttccctacgtaccgtttccttcgaacggggtccccggttcctacgggttacgtacgtacggggttcgacgttaggggtaacgtcgttacgggtaacgaaccctaacgttttaccgtaaccccgtaccctacctaaacgtacgtaaactaacggtcccgtacggtaagggtaaccttcggaaagaagtcgtcgtcgtaacgttaaattaacgtttactaggttacctactaacgtacgtaaaggttaaccttaaccgttttttaacccacgtaacggttaacgtacgttaccctaaccgtttacccgggtaccgaaaacgggtcccggtaacgtaacccgggtacggtaaagttaaccgttaaaaacgggtaaccgttcggtgggtaaccgttccgaaccctaaccaaccgttctttacgggtcccttttaccg

SEQ ID NO: 170576 - DNA, 515 bp, Homo sapiens
  misc_feature: GYAE6OF01CRUP9.27.78.H01.1.454.CMB.1.raw
  modified_base (442)..(442): a, c, t, g, unknown or other
  misc_feature (442)..(442): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtatagcttacactggtaccagcagaagccaggtcagtctacaaagctctcatcaagtatgcttcccagtccttctcacgggtcccctgaggttcagtggcagtgatcgtgggacacatttcaccctcaccatcaatagcctggaagctagaaagatgctgactaacttattactgtcatcagagtacttactttacctcaaagtnaatctaaccttcggaccaagggaccacggactggaagaattaaacgactgtaggctcgacaccatctgttacc

SEQ ID NO: 170577 - DNA, 526 bp, Homo sapiens
  misc_feature: GYAE6OF01A97S8.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgagttcagtggcagtggatcgtgggacactatttccaccctcaccatcaatacgcctaggaagctagaagtactgctagactaactttattactgtacatcagtagtacttactttacctacaagtgactctaccttcggaccaagggacacgactaggacgtaattaaacgacgtgtggctgaccacattcgtgttacc

SEQ ID NO: 170578 - DNA, 539 bp, Homo sapiens
  misc_feature: GYAE6OF01CUKSD.27.78.H01.1.454.CMB.1.raw
  modified_base (376)..(376): a, c, t, g, unknown or other
  misc_feature (376)..(376): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacgggtccctgacggttcagtgcagtgatcgngggacactatttccaccctcaccctatacaaactagcctaggaagctagaagatgcctgaactaacttattactgtacatacacgtaagttacttaacctttacctactaagtcgatccaccgtttccggaccaacgggacacgatacggagtaagtaaaacg

SEQ ID NO: 170579 - DNA, 598 bp, Homo sapiens
  misc_feature: GYAE6OF01C91KE.27.78.H01.1.454.CMB.1.raw
  modified_base (416)..(416): a, c, t, g, unknown or other
  misc_feature (416)..(416): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctcctcatcaagtactgccttcccagttccttcgtcgacggggttcccctcggtaggttcagtggcaggtggatcgtgggacactactttccacccttcacctatacaatagcctaggaacgctagaaagntcgctgacctaatttattactgtcatcaagtacgttactactttaccactaagttgacttccaccgtttacggacccgtaaacggggtaccaccggtaacgtagggtaaacgaactttaaaaccggaacttagggttacgggaccttacgggaccctaacccgttaactccgtttgttcccg

SEQ ID NO: 170580 - DNA, 586 bp, Homo sapiens
  misc_feature: GYAE6OF01EB04B.27.78.H01.1.454.CMB.1.raw
  modified_base (200)..(200): a, c, t, g, unknown or other
  misc_feature (200)..(200): n is a, c, g, or t
  modified_base (392)..(392): a, c, t, g, unknown or other
  misc_feature (392)..(392): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaagggganaaagtcaccatcacctgccgggccagtcagagcgttggtagtagcttacactggtaccagcagaagccaggtcagtctccaaagctcctcatcaagtatgcttcccagtccttctcgacgggtcccctcgaggttcagtggcagtggatcgtgggacacatttccaccctcaccatcaatacgcctggaacncgtagaagtatgctgactaacttacttactgtactatcaagtacgttaacttaacctttacctacgtaagttcgtaacttacctaacccgttaccggaccgtaaacggggaccaaccggtaacgtacgggaacgtaacgtttaaaaccggacgttaggtcggaccgtcgacccaacctacttcgtcgttacccg

SEQ ID NO: 170581 - DNA, 533 bp, Homo sapiens
  misc_feature: GYAE6OF01BYPNO.27.78.H01.1.454.CMB.1.raw
  modified_base (377)..(377): a, c, t, g, unknown or other
  misc_feature (377)..(377): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgttcccagtccttctcagggtcccctgagttcagtggcagtgatctggacactattcaccctcaccatcaatagcctggaanctgaagatgctgctaacttattactgtcatcaagatactactttaccataagtgtactcacccttcggaccaagggaccaacggactagggaagtaacgttaaaccggaacttggtacggacttacggacctaaccgaatccgttgttccttaccg

SEQ ID NO: 170582 - DNA, 498 bp, Homo sapiens
  misc_feature: GYAE6OF01A33T6.27.78.H01.1.454.CMB.1.raw
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
  modified_base (469)..(469): a, c, t, g, unknown or other
  misc_feature (469)..(469): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgacaacttattactgtcatcagagtactactttaccncaagtgatcaccttcggaccaagggcacgactgganattaaacgatgtggctgcaccntctgtcc

SEQ ID NO: 170583 - DNA, 686 bp, Homo sapiens
  misc_feature: GYAE6OF01BM4AT.27.78.H01.1.454.CMB.1.raw
tcagagcgtcgtctcacgaccggtgctcgatttagtgtgagtagtttgggtttggggaggtgagcaaaactgacaagtcaaggcaggaagtatgttgccatcacaactcattgggtttctgctgctctgggttccagtcctccaggggtgaaattgtgctgactctagtctccagactttcagtctgtgactcgaaaggagaaggtcaccatcacctgccgggccagtcagacgcgttggtagtagcttacactggtaccagtcagtaagccaggtcagtctacaaagctcctcatcaagtatgcttccagtccttcgtcgacggggtccctcgtacggttcaggtcggcaggtggatcgtgggtactactacgtttcaccctacgaccatacgaacgtacgtaccttaggaacgtcgttagaacgtagtacggtaccttacggtaacctaaacgtttaactttaaccgttaggttacctaacttaccgtaacggtaaccgttaacctttaaccgtttaacccgtacgttaaacggtacgtaacttaccgtaacccgtttaccgggacccgtaaacggggtacctaaccggttaaccgtaagggtaaacggtaaacgtttaaaaccggaaccgttaggtaccggtacgtacggtacctacctaagtttccgttcggttcttacccg

SEQ ID NO: 170584 - DNA, 494 bp, Homo sapiens
  misc_feature: GYAE6OF01CQWE0.27.78.H01.1.454.CMB.1.raw
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttcncagggtcccctgaggttcagtggcagtggatcgtgggacactattcaccctcaccatcaatagcctggaanctgaagatgctgactaattattactgtcatcagatactactttacncaagtnatctacttcggccaaggcacgtctaggagtaactaacgatgtgctgcacatctgtctac

SEQ ID NO: 170585 - DNA, 578 bp, Homo sapiens
  misc_feature: GYAE6OF01AZUWW.27.78.H01.1.454.CMB.1.raw
  modified_base (299)..(299): a, c, t, g, unknown or other
  misc_feature (299)..(299): n is a, c, g, or t
tcagagcgtcgtctcacgaccggtgctcgatttagtgtgagtagttgggttgggggcagtgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcaagaagccaggtcagtctaccaaagctcctcatcaaagtntcgcttcccagttccttctcacgggttcccctgaggttcagtggcagtggatcgtgggacactatttccacccttcaacctatccaaagttcgacccgtaggaagtctagaagtatgctgactaacttattactgtacatcaagtacttaacttacctttacctactaagttcgacttcccaccgtttaccggaccgtaaagggacctacgtaccgtaggtaacgtaacgttaaacggacgtgtacggacttacggacctacctacgtcgttacgttcc

SEQ ID NO: 170586 - DNA, 537 bp, Homo sapiens
  misc_feature: GYAE6OF01CTIIF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccgggccagtcagagcgttggtagtagcttacacgtggtaccagcagaagccaggtcagtctccaaagcctcctcatcaagtatcgccttcccagtccttctcacggggtcccctcgaggttcagtgcagtggatcgtggacacgtatttccaccctcaccatacaatacgcctaggaagtcgtagaagtatgactgacctaacttattacgtgtcatacagtagttaccttactttaccactaagtcactccacgttcggaccgaagggacacgactggaacgtaattaaacgatggtgctagacctacatctgttctacg

SEQ ID NO: 170587 - DNA, 501 bp, Homo sapiens
  misc_feature: GYAE6OF01CI1CU.27.78.H01.1.454.CMB.1.raw
  modified_base (416)..(416): a, c, t, g, unknown or other
  misc_feature (416)..(416): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggtagtagcttacactggtaccagcagaagccaggtcagtctccaaagctcctcatcaagtatgcttcccagtccttctcacgggtcccctgaggttcagtggcagtgatctgggacacatttcaccctcaccatcaatagcctggaanctgaagatgctgcaacttatactgtcatcagagtactacttacctcaagtgatcaccttcggccaaggcacgatggagataaacg

SEQ ID NO: 170588 - DNA, 518 bp, Homo sapiens
  misc_feature: GYAE6OF01BQ5TL.27.78.H01.1.454.CMB.1.raw
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgccttcccagtccttctcgacggggtcccctcgaggttcagtggcaggtggatcgtgggacactatttccacccctcacccatcaaatacgcctggaacgctagaagatgctgctaacttattactgtcatcagacgtactacttaccacagtnatcacctcgaccaaggacacganggagtataaacg

SEQ ID NO: 170589 - DNA, 532 bp, Homo sapiens
  misc_feature: GYAE6OF01BVJGL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacgatttcaccctcaccatacaatacgcctaggaagctagaagatcgctgactaacttatactgtacatcaagtagtacttactttacctactaagtgtactcctaccgttcggacaacggacacgtacgtaggagtaacgttaaacgactcggtgactacgaccacatctgttctaccg

SEQ ID NO: 170590 - DNA, 565 bp, Homo sapiens
  misc_feature: GYAE6OF01D477R.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcagtggcagtggatcgtgggacacgatttcaccctcaccatacaatacgcctaggaagctagaagatgctagactaacttattactgtacatacagtacgttacttaacctttaacctacgtaagtcgtaacttcctacccgttaccggaccgaacgggtaccaccgaacgtaggaacgtaattaaaacggacgttaggtcggacgtcggaccacctacttctggttaccc

SEQ ID NO: 170591 - DNA, 537 bp, Homo sapiens
  misc_feature: GYAE6OF01B2NBP.27.78.H01.1.454.CMB.1.raw
  modified_base (414)..(414): a, c, t, g, unknown or other
  misc_feature (414)..(414): n is a, c, g, or t
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccagggtgaaattgtgctgactcagtctccagactttcagtctgtgactcaaaggagaaagtcaccatcacctgccggcagtcagagcgttggtagtagcttacactggtaccagcagaagccagtcagtcaccaaagctcctcatcaagtatgccttccagtccttctcgacggggtcccctgagttcagtgcagtggatcgtgggacacatttcaccgtcaccatacaatacgcctaggaanctagaagtatgctgactaaacttacttactgtcatacagtacgtactactttaccnctaagtcgactacaccgttcggaccgaacggtacaccgtacgtaggaacgtaacgttaaacgtaacg

SEQ ID NO: 170592 - DNA, 543 bp, Homo sapiens
  misc_feature: GYAE6OF01CAYVF.27.78.H01.1.454.CMB.1.raw
tcagagcgtcgtctcacgaccggtgctcgatttagtgtgagtagtttgggtttgggatgacgcaaaactgacaagtcaagggcaggaagatgtgccatcacaactcattgggtttctgctgctctgggttccagcctccaggggtgaaattggtgctgactcagtctccagacctttcagtctcgtgactccaaaggagaaacgtccaccatcacctgccggccagtcaggagcgttggagtagcttacactggtaccagcagaagccaggtcagtctccaaagctcctcatcaagtatgcttcccagtccctttctcacggggtcccctcgaggttcagtggcagtggatcgtgggacactactttccaccccttcaaccctataccaaattacgccctaggaagcctaggaagatgctagctaacttattactgtcatcagattacttacttactacaagtcgattccaccttcggaccaaagggaccacggacgtaggaagtattaaaccgattcgtggctggccacattctgtcttacc

SEQ ID NO: 170593 - DNA, 611 bp, Homo sapiens
  misc_feature: GYAE6OF01DLKBL.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaagctcctcatacaagtatcgcttccagtccttctcgacggggtcccctcgaggttcagtggcaggtggatcgtgggacactactttccaccctcacctatactaatacgaccgtaggaacgctaggaagtagtcgacgttgtaacctaactttaacttacgttgtactacttacagtaacgttaaccttaacctttacccgttacaacggttacgtaacttaccgtaaccccgtttaccgggaccgaaacggggtaacccgaacggtaacgtaacgggaaagttaaagttaaaaacccgg

SEQ ID NO: 170594 - DNA, 513 bp, Homo sapiens
  misc_feature: GYAE6OF01D17TX.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcaggggtcccctgagttcagtggcagtggatctggacacatttccaccctcaccatcaatagcctggaagctagaagatgctgctaacttattactgtcatcagtatactactttacctanaagtgatcaccttcggaccaagggacacgactggaagaattaaacgaactggacggctacgaccaccattctgtcttacc

SEQ ID NO: 170595 - DNA, 547 bp, Homo sapiens
  misc_feature: GYAE6OF01CN23B.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctcctcatacaagtatcgcttcccagtccttctcgacggggtcccctgacggttcagtggcagtggatcgtgggatacgatttccaccctcacccatacaaatacgcctaggaacgctagaagatgactgactaacttactactgtacatcagtacgttacttactttacctactaagtcgacttactaccgttcggaccaagggtacacgactaggagtaagttaaaacgg

SEQ ID NO: 170596 - DNA, 624 bp, Homo sapiens
  misc_feature: GYAE6OF01A6SW8.27.78.H01.1.454.CMB.1.raw
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaaattgtgctgactcagtctccagactttcagtctgtgactccaaaggagaaagtcaccatcacctgccggccagtcagagcgttggtagtagcttacactggtaccagcagaagccaggtcagtctccaaagcctcctcatcaagtatgcttcccagtccttctcgacgggtcccctcgtaggttcagtcggcaggtggatcgtgggactacgtatttccgacccctcaaccctataccaaagtacgccgtagggaaacgccgttaggaacgtagtcgacttcggaccttaaactttagttaaccttgttaccaacgttacagtaacgtttaaccgttaaccttttaaccgtacgtaacgttcgtaacttcctaccccgttacggacccgtaaacggggtaccctaacggaaccgtacgggtaaaggtaacgttaaaaacccggg

SEQ ID NO: 170597 - DNA, 737 bp, Homo sapiens
  misc_feature: GYAE6OF01DZPTT.27.78.H01.1.454.CMB.1.raw
tcagagcgtcgtctcacgaccggtgctcgatttagtgtgagtagtttgggtttgggggtcggatgagacaaacgtgacaagtcggaaggcaggaagatggttgccatcaccaacgtctattgggtttctgctgctctgggtccagcctcgagggtcgaagttgtgctgactcacgtctccagactttcacgtcgtgtgactccaaaggaggaaacgtcaccgactccacctgaccgggccagtacacgagccgttgggtagtagtacttaacacgtcggtaccagacaagaacgtcctaaggtctagtacctaccaaagcctaccctacactacgaacgttactacggcctttcccacgttccttcttccgtacggggttccccctcggtacggtttaccgaacggtccggggtcctaggtacgggtaacttccgtagggggtacaacgtacgttttccgaccccgttacgacctaattacctaaactaccggtacccttacgggaaccgtacgtagaaacggtatcggacccttaggacccttaacggttatttaccgtaggtcctaagttcgaacgtacgtttacttaccttttaccgtactaagttcgtaacttactaacccgtttcgggaacctaacgggtacctaccggtaacgttcggggaacgttaaacggttaaaccgtaaacggtaggttcgaccgttcgaaccgtaccctaagtccgttggttaccc

SEQ ID NO: 170598 - DNA, 572 bp, Homo sapiens
  misc_feature: GYAE6OF01DUZ63.27.78.H01.1.454.CMB.1.raw
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatcacctgccggcagtcagagcgttggtagtagcttacactggtaccagcagaagccaggtcagtcctaccaaagcctcctcatacaagtactcgtccttcccgacgttcccttcgtccgtaccggggttcccccgtcggtacggttccgaggtcggcgtaggtggattcgtagggacctactactttccaccctacaccctatcaatacgcgtaggaactcgtagaagntcgacgtntactaacttatactgtactatcgagtacgttaaccttacttaccatagtcatccgtaccgtcgaccgaaggacacgagagaagtaagtaaacgg

SEQ ID NO: 170599 - DNA, 598 bp, Homo sapiens
  misc_feature: GYAE6OF01CEAHJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatcgtgggacactatttccaccctcacccatccaaatacgcctagggaagcctaggaagatggctgacctaaactttattacctgtcatcaagtacgttaaccttaaccttttaccctactaagttcgtacttaccgtacccgtttaccgggacccaaaggggacccaaccggtacgtagggaagtaaacgttaaaaccggaaacttggtacgggtcttacggaccctaacccgtatttccttgttccctttaccg

SEQ ID NO: 170600 - DNA, 537 bp, Homo sapiens
  misc_feature: GYAE6OF01D0B45.27.78.H01.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctttgggttccagcctccaggggtnaaattgtgctgactcagtctccagactttcagtctgtgactccaaaggnaaagtcaccatcacctgccgggccagtcagagcgttggtagtagcttacactggtaccagcagaagccaggtcagtctaccaaagctcctcatacaagtatcgcttcccagtccttctcgacggggtcccctgaggttcagtggcagtggatcgtgggactacatttccaccctcaccatacaatagcctaggaagctagaagatgctagctaacttattactgtcatcagacgttacttactttaacctcaagtgactcctaccgttcggaccgaacggacacgaactaggataagttaaacgtaacg

SEQ ID NO: 170601 - DNA, 635 bp, Homo sapiens
  misc_feature: GYAE6OF01DZ4O5.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcaagaagccaggtcagtctccaaagctcctcatcaagtatgcttcccagtccttctcacgggtcccctcgaggttcagtggcagtggatcgtgggacactatttcaccctcacccatcaaatacgcctaggaacgctaggaagattcggctcggacctaaactttactttaacttcgtacaataccgtaagtaacgttaaccttaacttttacccgtacgaaacggttgtaacttacccgtaaccctttaccggggacccgaaaacggggtacccaacgtaacccgttagggaaacgtaaacgtttaaaaaccggaacggttcggttaacgggaccttacgggtacccaaaccctagttccttcggttcctttaacccg

SEQ ID NO: 170602 - DNA, 505 bp, Homo sapiens
  misc_feature: GYAE6OF01DYKF8.27.78.H01.1.454.CMB.1.raw
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatcgtgggacactatttccaccctcacccatcaatagcctaggaanctagaagatgctgctaacttattactgtcatcagatactacttacctcaagtgatcacttcggccaagggacacgatggagaattaacgatgtgctagcactatctgtcttacc

SEQ ID NO: 170603 - DNA, 553 bp, Homo sapiens
  misc_feature: GYAE6OF01CLT1P.27.78.H01.1.454.CMB.1.raw
  modified_base (390)..(390): a, c, t, g, unknown or other
  misc_feature (390)..(390): n is a, c, g, or t
  modified_base (455)..(455): a, c, t, g, unknown or other
  misc_feature (455)..(455): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttctcacgggtcccctcgaggttcaggtggcagtggatcgtgggacactactttccaccctcaccatacaatacgcctaggaanctagaagtatgctgactaacttattactgtacatacagacttaaccttactttacctacaagttnacttcctaccgttacggaccaacgggaccacgtacgtaggaacgtaagttaaacgacgttggtacgtctcgaccctaccattccgttgttccttaccc

SEQ ID NO: 170604 - DNA, 513 bp, Homo sapiens
  misc_feature: GYAE6OF01CFPRG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtgcagtgatctggacacatttcaccctcaccatcaatagcctggaagctagaagatgctgactaactttattactgtcatcagacgtactactttacctcaagtgatcaccgttcggaccaagggacctacggactagggagtaacttaaacgaactggtcggctgcacatctgtcttac

SEQ ID NO: 170605 - DNA, 919 bp, Homo sapiens
  misc_feature: GYAE6OF01ASN1W.27.78.H01.1.454.CMB.1.raw
  modified_base (162)..(162): a, c, t, g, unknown or other
  misc_feature (162)..(162): n is a, c, g, or t
tcagagcgtcgtctcacgaccggtgctcgatttagtgtgagtagtttggggttgggggtcgagtgagcaaaactggacaacgttcaacggcgaggaacgagtcgtttgccattcgacaactcattggtttctgctgctctgggttccagccctccaggggtntaagttgtgctgtacgttctagttctcctagtacttcgagtctgtgactcgaaggagaaagtcaccgatcaccggtagccgggccaggtccgagggacgtcggttaggtacgttacgcctttacgacgtcggtaacccacggtcctaagggtaaacgtcccgtaagggttaccttaaggttaccttacccgaaaaggttcccgttacccttacgtaacgtttaccggaaacggttacgtcggtccctttaccccggaacgggttccccgtttaccgtccgggtaaccggggggttccccccgttacgggtaccgggtttaccgtaaacggttaccgggtaccgtaagggttacggggtaacttaccggtaaacgggggtaacctaacgtacgtttttaccccgaacccccgtttaccgtaacccgtaacgttaacccggaaacgttaccggtcccgttaacgggtaaaccgtcccgtaagggaaacggtaacgtacggaccgttaacggtaaccttaaccgtttaactttaacgttacgtttaccgtaacttaaccgtaacggtaaaccgtttaaccgttacccgttttaacccgtacgtaaacggtttaccggaaccttacccgtaaccccggtttaccggaaccgtaaacgggtaccttaaccggtaacgttaagggtaaacgtaagttaaaccggtacgttacggtacgtaccgttacggtacccgtaaccgtacggttccggttcgttacccg

SEQ ID NO: 170606 - DNA, 531 bp, Homo sapiens
  misc_feature: GYAE6OF01CKUVS.27.78.H01.1.454.CMB.1.raw
  modified_base (196)..(196): a, c, t, g, unknown or other
  misc_feature (196)..(196): n is a, c, g, or t
  modified_base (449)..(449): a, c, t, g, unknown or other
  misc_feature (449)..(449): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatcacctgccgggccagtcagagcgttggtagtagcttacactggtaccagcagaagccaggtcagtctccaaaagctcctcatcaagtatgccttcccagtcccttctccacggggtcccctcggaggttcaggtggcagtggatcgtgggacactatttccaccctcaccatcaaatagcctggaagctgaagatgctgacaactttattactgtcatcaagtagtaaccttactttaccnctaagtgattcctaccttcggaccaaagggacacgactggaataagttaaacgacttggcggctagcaaccatctgtcttac

SEQ ID NO: 170607 - DNA, 513 bp, Homo sapiens
  misc_feature: GYAE6OF01DWM51.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcagaagccaggtcagtctcaaagctcctcatcaagtatgcttcccagtccttctcagggtcccctcgaggttcagtggcagtggatctgggacacatttcaccctcaccatcaatagcctggaagctagagatgctgcaactttattactgtacatcagtatactactttaacctctaagtgattcaccttcggacccaagggaccacgactaggagtaagttaaacgaacgtgtggctgcaacatctgtcttac

SEQ ID NO: 170608 - DNA, 538 bp, Homo sapiens
  misc_feature: GYAE6OF01BQK3C.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacgggtccctcgaggttcagtggcaggtggatcgtgggacacatttcacccctcaccatcaatacgcctggaacgctagaagatgctgctaacttatactgtcatcagtacgtactactttacctactaagtgtaatcctacccgttcggacccaaaggggtaccacggaacgtgggaagtaagttaaaaccgg

SEQ ID NO: 170609 - DNA, 752 bp, Homo sapiens
  misc_feature: GYAE6OF01CUHER.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgtggtagtagcttacactggtaccagcagaagccaggtcagtcctacaaagcctcctcatcaaggttactcgcttcccgagttcccttcgtccgaaccggggttccccctacggtacgggttacacgggttcggccgtaggttagggtactcggtacggggacctaaccgttaacttttcccaacccccttactaaccctaactaccgtaaacgttacggacccgtagggaaacgtaccgtaaggtaaacgacgttacggtaccgttacggtaacccttaaacgttttacgtttaaccttacggttacctaagttacccgtaaaggtaaccggtttaacctttaacccctttaaacccgttaaacgttaaacggtacggttaacccttacccgttaaaccccggtttacccggggaaccccgttaaaaccgggggaccctaaaccgggtaaaccttacggggtaaaccgttaaaacgtttaaaaacccggg

SEQ ID NO: 170610 - DNA, 501 bp, Homo sapiens
  misc_feature: GYAE6OF01EPE8G.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgacaactttattactgtcatcagagtactactttacctcaagtgatcaccttcggccaagggacacggactggagattaaacgactgtgctgacaccatctgtcc

SEQ ID NO: 170611 - DNA, 537 bp, Homo sapiens
  misc_feature: GYAE6OF01B2EW8.27.78.H01.1.454.CMB.1.raw
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (528)..(528): a, c, t, g, unknown or other
  misc_feature (528)..(528): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctcctcatcaagtatgccttcccagtccttctcgacgggtcccctgaggttcagtggcagtgatcgtgggacactatttccaccctcaccatcaatacgcctaggaanctagaaagtntgctgactaactttattactgtacatcaagtacgttacttaactttacctacaagttgacttctaccgttcggaccaagggaccacgacgtaggaactaattaaacgactggtagctacgacaacntcgtgttcc

SEQ ID NO: 170612 - DNA, 494 bp, Homo sapiens
  misc_feature: GYAE6OF01AXSP1.27.78.H01.1.454.CMB.1.raw
  modified_base (382)..(382): a, c, t, g, unknown or other
  misc_feature (382)..(382): n is a, c, g, or t
  modified_base (478)..(478): a, c, t, g, unknown or other
  misc_feature (478)..(478): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgcaacttattactgtcatcagtagtactactttacctcaagtgatcaccttcggccaagggcacgactggagattaaacgactgngctgcacatctgtctc

SEQ ID NO: 170613 - DNA, 511 bp, Homo sapiens
  misc_feature: GYAE6OF01BLRAU.27.78.H01.1.454.CMB.1.raw
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccgctccagggtggaattagttgctgactcagtctccagactttctagtctgtgactccaaaggaagaaagtacaccactcacctcgccgggccagtcagagcgttggtagtagcttacactggtaccagcagaagccaggtcagtctccaaagctcctcatcaagtatgccttcccagtccttctcacggggtcccctcgaggttcagtggcagtggatctggggacactatttccaccctcaccatcaatagcctggaagctgaagatgctgcaaactttattactgtcatcagagttactacctttacncaagtgatccaccgttcggcaaggacncacgtggaagtattaaacgatgnggctncacatctgtctcac

SEQ ID NO: 170614 - DNA, 493 bp, Homo sapiens
  misc_feature: GYAE6OF01A710B.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctggacacatttcaccctcaccatcaatagcctggaagctgaagatgctgctaacttattactgtcatcagagtactacttacctcaagtgatcaccttcggaccaagggacacgactggagattaacgactgtgctgcacatctgtctc

SEQ ID NO: 170615 - DNA, 537 bp, Homo sapiens
  misc_feature: GYAE6OF01BMM00.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcaggtggatcgtgggacactatttccaccctcacccatcaaatagccctggaacgctaggaacgatggctgactaacttattactgtacatcagtacgtactactttaccactaagtcaatcaccttcggacccaagggaccacgaacctggaagtagttaaaaccgg

SEQ ID NO: 170616 - DNA, 621 bp, Homo sapiens
  misc_feature: GYAE6OF01CW92N.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcacgggtcccctgaggttcaggtgcagtggatcgtgggacacatttccaccctcaccatacaatacgcctaggaagtctagaaacgatgctagactaaactttacttactgtaccatacgtagtaagttaccttaaccttttaacctacgtaaacgttgtaacttacctaacccgtttaccgggaacccgtaaacggggaacctaaaccggaaccggtaacgggtaaacggtaaagtttaaaaaccggaacgtttacgggtagggtaccgtaccggaccctaaacccgtattcccgttgtttaaccccg

SEQ ID NO: 170617 - DNA, 510 bp, Homo sapiens
  misc_feature: GYAE6OF01B39SL.27.78.H01.1.454.CMB.1.raw
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagcctcctcatcaagtatcgcttccagtccttctcgacgggtcccctgagttcagtgcagtggatcgtgggacactattccaccctcaccatcaatagcctaggaagctagaagatgctgactaacttactactgtacatcagtagtactactttactacaagtnatcnccttcggaccaagggcacgatgagtataaacg

SEQ ID NO: 170618 - DNA, 517 bp, Homo sapiens
  misc_feature: GYAE6OF01CHERX.27.78.H01.1.454.CMB.1.raw
  modified_base (437)..(437): a, c, t, g, unknown or other
  misc_feature (437)..(437): n is a, c, g, or t
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttccaccctcaccatcaaatacgcctgggaacgctgaaagtatcgactgactaacttattactgtcatcagatactactttacncaagtgatctaccttcggaccaaagggacacgactaggaagtacttaaacgacttgacgtntacgcacatctgtcttacc

SEQ ID NO: 170619 - DNA, 532 bp, Homo sapiens
  misc_feature: GYAE6OF01AZX0E.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaagganaaagtcaccatcacctgccgggcagtcagagcgttggtagtagcttacactggtaccagcagaagccaggtcagtctccaaagctcctcatcaagtatgcttcccagtccttctcacgggtcccctcgagttcagtcgcagtggatctgggacacgtactttccacccttcaacctataccaaatacgaccctaggaacgctagaagatgctgactaacttacttactgtactatccgaagtacgtacttacttacctataagtgactctaccgttcggacaacggacacgagtggaagtaacttaaacgagtggacgctacgcactatctgtctac

SEQ ID NO: 170620 - DNA, 491 bp, Homo sapiens
  misc_feature: GYAE6OF01D4YS5.27.78.H01.1.454.CMB.1.raw
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctgaagctagaagatgctgcaacttattactgtcatcagagtactacttactcagtgatctaccttcggccaagggcacgctggagattaaacgactgtgctgcacatcngtctac

SEQ ID NO: 170621 - DNA, 562 bp, Homo sapiens
  misc_feature: GYAE6OF01CD7JE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacactactttcaccctcacatcaatagcctggaagctgaagatgctgactaacttattactgtcatcaagtacgttaacttactttacctactaagtcgtattcctaccttaccgggaccgtaaagggaccaaccggtacgtagggtaacgtaacgttaaaacggaacgttggtacggtacctacggaccacccgtattcctgttccttacc

SEQ ID NO: 170622 - DNA, 585 bp, Homo sapiens
  misc_feature: GYAE6OF01DVGMA.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccggactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgagttcagtggcagtggatcgtggacactatttccacccttcacccatacaaatacgcccgtaggaagtctagaagatgctgactaactttattactgtcatcagtagttaccttaactttacctactaagtcgtacttcctaccttccgggaccgaaacgggaccaacggacgtagggtaacgtaaacgttaaaccggaacgttggtacgggtacctacggtaccctaacccgtattccttacggttcctttacccg

SEQ ID NO: 170623 - DNA, 509 bp, Homo sapiens
  misc_feature: GYAE6OF01BLU50.27.78.H01.1.454.CMB.1.raw
  modified_base (227)..(227): a, c, t, g, unknown or other
  misc_feature (227)..(227): n is a, c, g, or t
  modified_base (415)..(415): a, c, t, g, unknown or other
  misc_feature (415)..(415): n is a, c, g, or t
  modified_base (501)..(501): a, c, t, g, unknown or other
  misc_feature (501)..(501): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagactttcagtctgtgactccaaaaggngaaagtcaccatcacctgccgggccagtcagagcgttggtagtagcttacactggtaccagcagaagccaggtcagtctccaaagctcctcatcaagtatgcttccagtccttctcaggggtcccctcgaggttcagtggcgagtggatctgggacacatttcaccctcaccatcaatagcctggaanctgaagatgctgacaacttattactgtcatcagtagtactactttacctcaagtgattcaccttcggaccaagggacacgatgganattaaacg

SEQ ID NO: 170624 - DNA, 937 bp, Homo sapiens
  misc_feature: GYAE6OF01ATAGW.27.78.H01.1.454.CMB.1.raw
tcagagcgtcgtctcacgaccggtgctcgatttagtgtgagtagtttgggtttggggggtcggatgagacaaaacgtgacgaagtcggaaggcaggaagatggttgtccatcaccaacgtctattggttttctgctgctctgggttccagcctcgagggtcgaagttgtgctgactcacgtctccagactttcacgtcgtgtgactccaaaggaggaacgtcaccgactccacctgaccggcagtacacgagccgttaggtagtagtcttacacgtcggtaccagacaagaacgtcctaggtcctaggtacctaccgaaacgcctacctacgactacgaacgttacgtacgtcctttcccgagtttccctttaccgttaccgtaccggggtttccccctacggttacgggtttaccggaacggttccggggtaccctagggttacgggtaacttaccggtacggggaaccgtaaccgttaccgttttacccggaacccccgttaccggtaaacccgtaacgtttaccgttaaaccttaccggtacccgtttacgggaaaccgttaccgttaacggaaacgggttacgttaccgggtaccgtttaccggaaccttaaaccgttttacgtttaaccggtaacggttaccttaacggttaccgttaaacggtttaaacgttttaacccgtttaacccgttttaacccgttaaccggttaaacggttaacgtaacccttttaaccgtttaaacccccggttttaaccgggtaacccccgttaaaacgggggttacccctaaacccgggttaaaccgggtttaccgggggtaaaaccggttaaacggttaaaaaccccgggttaaacggtttcggggtaaaccgttccgttaacccggtaacccgttaacccgttacgggtttcccgttaccggtttacccc

SEQ ID NO: 170625 - DNA, 497 bp, Homo sapiens
  misc_feature: GYAE6OF01C9GK8.27.78.H01.1.454.CMB.1.raw
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcacggggtcccctcgaggttcagtggcagtggatcgtgggacacatttccaccctnaccatcaatagcctggaagctagaagatgctgcaacttattactgtcatcagatactactttaccnaagtnatcaccttcgaccaagggacncgatggagattaaacgactgtggctgacacatctgtc

SEQ ID NO: 170626 - DNA, 522 bp, Homo sapiens
  misc_feature: GYAE6OF01ESOPY.27.78.H01.1.454.CMB.1.raw
  modified_base (451)..(451): a, c, t, g, unknown or other
  misc_feature (451)..(451): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctcctcatcaagtatgcttcccagtccttctcgacggggtcccctgaggttcagtggcagtggatcgtgggacactatttccaccctcaccatcaatacgcctggaagctagaagatgctgactaacttattactgtacatcagtatacttactttaccacaagtnattcaccgttcggaccaagggaccacgactagggaataattaaacgattggngctgaccacctntcgtgtc

SEQ ID NO: 170627 - DNA, 499 bp, Homo sapiens
  misc_feature: GYAE6OF01AWMYZ.27.78.H01.1.454.CMB.1.raw
  modified_base (389)..(389): a, c, t, g, unknown or other
  misc_feature (389)..(389): n is a, c, g, or t
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagntgctgcaacttattactgtcatcagagtactactttacctacaagtgatcaccttcggccaagggaccacgactggagattaacgactgnggctcgcacatctgtcttac

SEQ ID NO: 170628 - DNA, 523 bp, Homo sapiens
  misc_feature: GYAE6OF01CWSTK.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcacccatacaatagcctggaagctagaagatgctagctaacttattactgtacatcagagttactaactttacctcaagtgactcaccttcggaccaagggacacgactggaagtattaaacgactggtggctcgaccacctatccgtgttaccc

SEQ ID NO: 170629 - DNA, 495 bp, Homo sapiens
  misc_feature: GYAE6OF01B22AG.27.78.H01.1.454.CMB.1.raw
  modified_base (383)..(383): a, c, t, g, unknown or other
  misc_feature (383)..(383): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggcacgactggagattaaacgactgtggctgcacatctgtctc

SEQ ID NO: 170630 - DNA, 562 bp, Homo sapiens
  misc_feature: GYAE6OF01BL477.27.78.H01.1.454.CMB.1.raw
  modified_base (463)..(463): a, c, t, g, unknown or other
  misc_feature (463)..(463): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgagttcagtggcgagtggatcgtggacacgtacttccaccctcaacctataccaatacgaccgtaggaacgcgtagaacgtatgctgacctaacttattactgtacatcagtacgtaccttaactttaccactaacgtntactcctaccgttacggaccgaacgggacacgtacgtacggaagtacgttaaacgtacgttggtacgtctacgacctaccctattcctgttccttaccg

SEQ ID NO: 170631 - DNA, 776 bp, Homo sapiens
  misc_feature: GYAE6OF01CMD61.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggcagtcagagcgttggtagtagcttacactggtaccagcagaagccaggtcagtctaccaaagctcctcatacaagtatcgccttcccagttccttctccgacggggttccccctcggtaacggttccaaggtcggcgtaaggtcgggtaacgtcggtacggggtaaccaacgtaacttttaccaacccccttacaaccctaacttacctaaaactacggtaccccgttaggggtaaaacgtcgttaacggaaaaggtagttaggtaccgttaacgggtaaccttaaaaccgttttaagtttaacctttacggtaaccttaacgtaaccgtaaacggttaaacggtttaaccttttaaacccgttttaacccttaacgttaaaacggttcggtaaacttacccgttaacccgtttaaccgggaacccggtaaacggggtaaccgtaaccggaaacgttagggtaaaacgtaaaacgtttaaaaccgggtaaaccgtttgggtaccgggtaccgttacggaacccttaaccgtaatttcccgttcggttacctttaacccg

SEQ ID NO: 170632 - DNA, 537 bp, Homo sapiens
  misc_feature: GYAE6OF01CCU27.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcgacggggtcccctcgaggttcagtggcaggtggatctgggacactatttccaccctcacccatcaaatacgcctggaagctagaagntgctgctaacttattactgtacatacagtagtacttactttaccataagtgatctaccgttccggaccgaacgggtacacggactacggaagtaagttaaaaccgg

SEQ ID NO: 170633 - DNA, 538 bp, Homo sapiens
  misc_feature: GYAE6OF01B3ZRF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttccaccctcaccatcaatagcctggaagctagaagatgctgactaacttattactgtcatcaagatactacttacctcaagtgatcaccgttcggaccaagggaccaacgacgtagggaacgtaacgttaaaacgaacgttggtacggtactcggacctacccaattcctgttccttaccg

SEQ ID NO: 170634 - DNA, 549 bp, Homo sapiens
  misc_feature: GYAE6OF01A5ANB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggagtagcttacactggtaccagcagaagccaggtcagtctccaaagctcctcatcaagtatgccttcccagttccttctcgacgggtcccctgacggttcagtggcaggtggatcgtgggactacgtatttccaccctcacctatacaatacgccgtaggaacgctagaagatgctagactaacttattactgtacatcagtagttaccttactttacctactaagtagtactacctaccttccggacaacgggaccacgagtaggacgtaattaacggaacttggtcgtacacgtaccactatctgtcttaccg

SEQ ID NO: 170635 - DNA, 508 bp, Homo sapiens
  misc_feature: GYAE6OF01EDBHP.27.78.H01.1.454.CMB.1.raw
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcaccctcaccatcaatagcctggaagctagaagatgctgactaacttattactgtcatcagagtactactttacctanaagtgatctaccttcggccaagggaccacgactaggagaacgttaacgactgaggctgcaccatctgtcttac

SEQ ID NO: 170636 - DNA, 512 bp, Homo sapiens
  misc_feature: GYAE6OF01B7IHY.27.78.H01.1.454.CMB.1.raw
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcaggtggcagtggatcgtgggacacatttcaccctcaccatcaatagcctggaanctagaagatgctgactaacttattactgtacatcagtagtacctactttacctcaagtgtatccacttccggacaacgggacacgactggaagattaaacgactggtgctgcactatctgtctac

SEQ ID NO: 170637 - DNA, 520 bp, Homo sapiens
  misc_feature: GYAE6OF01ETGV0.27.78.H01.1.454.CMB.1.raw
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcacgggtcccctcgacggttcagtggcagtggatcgtgggacactatttcaccctcaccatcaatacgcctggaagctagaagatgctgctaacttattactgtcatcagtacgtactacctttacctctaagtntatcaccttcggaccaagggacacgactggagattaaacgg

SEQ ID NO: 170638 - DNA, 566 bp, Homo sapiens
  misc_feature: GYAE6OF01B3IYK.27.78.H01.1.454.CMB.1.raw
  modified_base (561)..(561): a, c, t, g, unknown or other
  misc_feature (561)..(561): n is a, c, g, or t
tcagagcgtcgtctcacgaccggtgctcgatttagtgtgagtagtttgggtttggggatgagaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagctcctcatcaagtatcgccttcccagtccttctcgacgggtcccctcgtaggttcaggtggcaggtggatcgtcgggacactagtttccaccctacaccatacaactacgccctaggaacgcgtaggaagattgctgactaacgtttatactgtacatcaagtacgttaacttacctttacctctaagttcgtaacttcctaaccgttccggaccgaacgggaccacgacgtaggaacgtaagttaaacgactaggtcgactgaccacctatactcgtcttntaccg

SEQ ID NO: 170639 - DNA, 594 bp, Homo sapiens
  misc_feature: GYAE6OF01B66WN.27.78.H01.1.454.CMB.1.raw
  modified_base (388)..(388): a, c, t, g, unknown or other
  misc_feature (388)..(388): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcacggggtcccctcgaggttcagtggcgagtggatcgtggacactatttccaccctcaccactcaatacgcctggaacnctagaagatgctgactaacttattactgtactatccgaagtaacttaccttaactttacctactaaggttacgtaacttaccgtaacccgttccggacccgaaacgggtaccaacggtaccgtaggggtaacgtaaacgtttaaaacggaacgttcggttacggacgttaccgtaccgaccctaattccttcggttcctttacccg

SEQ ID NO: 170640 - DNA, 503 bp, Homo sapiens
  misc_feature: GYAE6OF01DB23S.27.78.H01.1.454.CMB.1.raw
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtgcagtggatctgggacacatttcaccctcaccatcaatagcctaggaagctagaagatgctgactaacttattactgtcatcagtacgtactactttacctctaagtgatcaccttcggacaagggacacgactggagattaaacgactgnggctagcacntctgtctac

SEQ ID NO: 170641 - DNA, 528 bp, Homo sapiens
  misc_feature: GYAE6OF01AEQAI.27.78.H01.1.454.CMB.1.raw
  modified_base (179)..(179): a, c, t, g, unknown or other
  misc_feature (179)..(179): n is a, c, g, or t
  modified_base (473)..(473): a, c, t, g, unknown or other
  misc_feature (473)..(473): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacactttcaccctcacccatcaatacgcctggaacgcgtagaagatgctgactaacttatactgtcatcagacgtactactttaccncgtaagtcgtatcctccttcggaccaacggacacgacgtggagtagttaaaccgg

SEQ ID NO: 170642 - DNA, 552 bp, Homo sapiens
  misc_feature: GYAE6OF01BSQHT.27.78.H01.1.454.CMB.1.raw
  modified_base (460)..(460): a, c, t, g, unknown or other
  misc_feature (460)..(460): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagctcctcatcaagtatgcttcccagttccttctcgacgggtcccctgacggtttcagtggcagtggatctggggacacgtatttaccacccctacaccatacaatacgacctggaacgctagaagatgctgactaacttattactntacatacagtacgtacttaccttacctactaacgtgactctaccgttaccgaccgaaagggtaccacggacgtaggagtaagttaaaaccgg

SEQ ID NO: 170643 - DNA, 495 bp, Homo sapiens
  misc_feature: GYAE6OF01CHZAB.27.78.H01.1.454.CMB.1.raw
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtggacacatttcaccctcaccatcaatagcctaggaanctgaagatgctgctaacttattactgtcatcagatactactttacctnaagtnatcaccttcggcaaggcacgactggagtataaacgactgtggctgcacatctgtcttac

SEQ ID NO: 170644 - DNA, 525 bp, Homo sapiens
  misc_feature: GYAE6OF01CHFSJ.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgcccgggccagtcagagcgttggtagtagcttacactggtacagcagaagccaggtcagtctccaaagctcctcatcaagtatgcttcccagtccttctcagggtcccctcgaggttcagtggcagtggatcgtgggacacatttccaccctcaccatcaatagcctggaagctagaagatgctgactaacttattactgtcatcatagtacttactttacctacaagttgatccaccttcggaccaagggaccagactagggaagtacttaaacgaactggtaggcctgaccacctatccttgtccttaccg

SEQ ID NO: 170645 - DNA, 513 bp, Homo sapiens
  misc_feature: GYAE6OF01DE144.27.78.H01.1.454.CMB.1.raw
  modified_base (385)..(385): a, c, t, g, unknown or other
  misc_feature (385)..(385): n is a, c, g, or t
  modified_base (441)..(441): a, c, t, g, unknown or other
  misc_feature (441)..(441): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatctgggacacatttcaccctcaccatcaatagcctggaacnctagaagatgctagactaacttattactgtcatcaagtactacttactttacctanaagtgactctaccttcggccaagggaccacgacgtggaagtattaaagactgnggctagcacatctgtctac

SEQ ID NO: 170646 - DNA, 510 bp, Homo sapiens
  misc_feature: GYAE6OF01DUIPX.27.78.H01.1.454.CMB.1.raw
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttccagtccttctcacgggtcccctgacggttcagtggcagtggatcgtgggacacatttccaccctcaccatacaatacgcctggaagctagaagatgctgactaacttattactgtcatcagatactacttacctnaagtgatcnccttcgcaaggcaacgataggagtgtaaaacg

SEQ ID NO: 170647 - DNA, 510 bp, Homo sapiens
  misc_feature: GYAE6OF01DNQXS.27.78.H01.1.454.CMB.1.raw
  modified_base (382)..(382): a, c, t, g, unknown or other
  misc_feature (382)..(382): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctcgaggttcagtgcagtggatctgggacacattcaccctcaccatcagtagcctggaanctagaagatggctgactaacttattactgtcatcagagtactactttacctcaagtgatcaccttcggaccaagggtaccacgactaggagtaagttaaacgaagtgaggctgcacatctgtcttacc

SEQ ID NO: 170648 - DNA, 502 bp, Homo sapiens
  misc_feature: GYAE6OF01ERSBT.27.78.H01.1.454.CMB.1.raw
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctagaagatgctgcaacttattactgtcatcagtagtactactttaccncaagtgtatccaccttcggaccaagggacacgactaggagattaaacgactgtggctgcacatctgtcttc

SEQ ID NO: 170649 - DNA, 525 bp, Homo sapiens
  misc_feature: GYAE6OF01D8P9N.27.78.H01.1.454.CMB.1.raw
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttcttctgctctgggttccagcctccaggggtgaaattgtgctgactcagtctccagacttttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacactatttccaccctcaccatcaatacgcctggaagctagaagatgctgctaacttattactgtcatcagtactactactttacctntaagtgactcctaccttcggaccaagggaccacgactagggaagtaacgttaaacgaatggtgctgacctaccatcttgtcttctac

SEQ ID NO: 170650 - DNA, 534 bp, Homo sapiens
  misc_feature: GYAE6OF01C3P5U.27.78.H01.1.454.CMB.1.raw
  modified_base (454)..(454): a, c, t, g, unknown or other
  misc_feature (454)..(454): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacacttggtaccagcagaagccaggtcagtctccaaagctcctcatcaagtatgcttcccagtccttctcgacggggtcccctcgacggttcagtggcaggtggatcgtgggacactatttccaccctcaccatcaatacgcctaggaagctagaagatgctagactaactttattactgtcatcagacgttactactttactacaagtnactcaccttcggaccaagggaccacgactaggaagtaacttaaacgacttggtacggctagaccactatctgtccttacc

SEQ ID NO: 170651 - DNA, 538 bp, Homo sapiens
  misc_feature: GYAE6OF01C74G2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattccaccctcaccatcaatagcctggaagctagaagatgctgactaacttattactgtcatcagtacgtactactttacctactaagttgtatcctaccctttcgggaccctaaaggggacctacggacgtggaagtaacttaaacgaacgtgtaggactcgactacctatcctgttcttaccg

SEQ ID NO: 170652 - DNA, 551 bp, Homo sapiens
  misc_feature: GYAE6OF01A07IT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacactatttccaccctcaccatacaatacgcctaggaacgctagaagatgctgactaactttattactgtacatcagtacgttaccttactttacctactaagtagtacttacctacccttcgggaccaagggaccacggtacgtaggaagtaacttaaacggaacttcggtagcttagaccactatccttgtccttaccg

SEQ ID NO: 170653 - DNA, 831 bp, Homo sapiens
  misc_feature: GYAE6OF01CMA6F.27.78.H01.1.454.CMB.1.raw
tcagagcgtcgtctcacgaccggtgctcgatttagtgtgagtagtttgggttgggggatgagacaaaacgtgacgaagtcgaaggcaggaagatgttgccatcacaacgtcattggtttctgctgctctggtcagctcgagggtgaaagttgtgtctgactcgacgtctccagactttcagtcgtgtgacctccgaaaggagaaaagtcaaccgataccacctcggaccgggccagtacgagaggtcgttaggtagttacgttcttacgacgtacggtaaccaagacgtaagtaacgtcctagggttccaacggtacctaccgaaaaggccctaccgtacaactaccgtaaagttctccgtaccttcccagttccctttcgtaccgggtacggggtcccctacggtacggttctacgggtcgtacgaggtgactcggtacggaacctacgttacgtttccgaaccccgttacaaccgttaacttacaaaaccgttcggtacccgtaacggaagtacgtaacggtaacgtaacgttcgacgttacggaaaccgttaacgttttaacgtaacgttacgttaccggtaacttaaccgttaaacgggtttaacggttttaaccccttttaaacccgttttaaccccgtaacgttaacggtttaaaccgttaacctttaaccccggttaacccgttttacccgggaacccggtaaacggggtaacccgtaaccggtaaccggtaacgggtaaacggtaaacgttaaaccggtaacgttacggtaacggtaaccgtaccgtacgtaacccgtagtttcccgtccggttaccttaccg

SEQ ID NO: 170654 - DNA, 508 bp, Homo sapiens
  misc_feature: GYAE6OF01C5LXT.27.78.H01.1.454.CMB.1.raw
  modified_base (432)..(432): a, c, t, g, unknown or other
  misc_feature (432)..(432): n is a, c, g, or t
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaagctagaagatgctgacaacttattactgtcatcagagtactactttacctnaagtgtactcaccttacggccaagggaccacgactggaagtaacttaaacgatcgtagctgcaccntctgtctacc

SEQ ID NO: 170655 - DNA, 556 bp, Homo sapiens
  misc_feature: GYAE6OF01AVTT9.27.78.H01.1.454.CMB.1.raw
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtcctaccaaagcctcctcactcaagtatcgtaccttcccaacgttcccttcgtcgtacggggtcccctcggacggttcacggtggctaggtggatcgtagggactacgtactttcgacccctcacctactacaacgtacgacctaggaacgtcgtagaagngtcgctcgactaacttnttactgtacatcagtacgtactacttactactagtcatcgccttcgaccaacggacacgagtagagtaagtaacg

SEQ ID NO: 170656 - DNA, 703 bp, Homo sapiens
  misc_feature: GYAE6OF01BC3NZ.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtgaaattgtgctgactcagtctccagtactttcagtctgtgactacaaaggagaagtcaccatccacgtcgccggcagtcagagtcgttggtagtacgcttacacgtcgtaccagacaagacgcgaggtcagtcaccaaagcctcctcatacaagtatcgtccttacctacttcctctcgtaccgggttcccctcggtacggttcgaggtggactaggtcggatcggtaggactactacgtttaccaccctacgaacctactacgaagtacgaccgtacgggaacgcgtaggaaagtagtacgactacgtacttaactttactttacgttgtactacgttacgtaacgttaacgtttaacctttaaccgttttaaccctacgttaaacggttagtaaccttaccgtaaccccggtttaaccgggacccggtaaacggggtaaccctaaccgggtaacggttacgggaaacgtttaaacgttaaaaccgggaacggttacggtaccgggtacgttaccggaacccttaaccgtaccgtttcgttaccggtttacccc

SEQ ID NO: 170657 - DNA, 679 bp, Homo sapiens
  misc_feature: GYAE6OF01CUKEI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagctccagggtgaaattgtgctgactcagtctccagactttcagtctgtgactccaaaggagaaagtcaccatcacctgccgggccagtcagagcgttggtagtagcttacactggtaccagcagagcaggtcagtctaccaaagctcctcatacaagtatcgtccttcccagtccttctccgacgggtcccctcgaggttcagtggctagtggatctggacactacttccaccttcaccaactacaaacgtacgtaccgtaggaacgtccgtaggaacgtagtcggtacttacgtaaccgtaaactttacgtttaacttacgttacgtaattaccgtaaacggttaacgttaacctttaaccttttaaccctaacgtaacggttaacgtaaccttacccgtaacccgtttacccgggaccgtaaacggggaaccgtaaccgggtaaaccgtagggtaaacgtaaacggttaaaacggtaaccgttacggtacggtaccgttaacggacccgtaaaccctacgttaccgttcgttccgtttaacccg

SEQ ID NO: 170658 - DNA, 595 bp, Homo sapiens
  misc_feature: GYAE6OF01DZ32L.27.78.H01.1.454.CMB.1.raw
  modified_base (196)..(196): a, c, t, g, unknown or other
  misc_feature (196)..(196): n is a, c, g, or t
  modified_base (411)..(411): a, c, t, g, unknown or other
  misc_feature (411)..(411): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatcgcttcccagtcccttctcgacgggttcccctcggaggttccagtggcctaggtcggatcgtgggacacgtactttccaccctcaccctatacaatacgcctaggaagctagaagntaggctaggtctaaacgtttattacctgttactattacagtagttacttaacctttaaccgtactaagtcgtaattaccgtacccgtttccggacctaagggacctaaccgaacgtaggaacgtaacgttaaaacgaacttcggtacggtctacggtaccacctaagttcctggttccttaccg

SEQ ID NO: 170659 - DNA, 560 bp, Homo sapiens
  misc_feature: GYAE6OF01A7HFE.27.78.H01.1.454.CMB.1.raw
  modified_base (404)..(404): a, c, t, g, unknown or other
  misc_feature (404)..(404): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctaccaaagcctcctcatcaagtatgctccagtccttctcgacgggtcccctgtacggttcagtggcaggtggatcgtgggacacgtatttccaccctcaccatcaatacgcctaggaagctagaagntgctgactaactttatactcgtacatcatacgttacttacctttactactaagtcgtaatctaccgtacgaccgtaagggacacggtactacgggaataacgttaaacgaactagggtacggtactaccggactaaccgtacttcgtcgttacccg

SEQ ID NO: 170660 - DNA, 533 bp, Homo sapiens
  misc_feature: GYAE6OF01A4AHP.27.78.H01.1.454.CMB.1.raw
  modified_base (425)..(425): a, c, t, g, unknown or other
  misc_feature (425)..(425): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcacccatcaatagcctggaagctagaanatgctgcaacttattactgtcatcagtagtacttaactttacctataagtgtatccacctttccggaccaaacgggtaccaacggacctaggaagtaattaaaaccgg

SEQ ID NO: 170661 - DNA, 526 bp, Homo sapiens
  misc_feature: GYAE6OF01DNBV0.27.78.H01.1.454.CMB.1.raw
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagatcctcatcaagtatgcttcccagtccttctcacgggtcccctcgaggttcagtggcagtggatcgtgggacactattccaccctcaccatcaatagcctaggaagctagaagatgctagacaactttattactgtcatcagtacgttacttactttaacctnaagtgactccaccttacggaccaagggacacggactaggagtaacttaaacgactgaggctgaccacattcctgtcttacg

SEQ ID NO: 170662 - DNA, 511 bp, Homo sapiens
  misc_feature: GYAE6OF01ENXB8.27.78.H01.1.454.CMB.1.raw
  modified_base (441)..(441): a, c, t, g, unknown or other
  misc_feature (441)..(441): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttccaccctcaccatcaatacgcctggaagctagaagatgctgctaacttattactgtcatcagtatacttactttaccactaagtnactcaccttcggaccgaaggacacgacgtaggagaattaacgaactgagctacgccacatcttgtcttac

SEQ ID NO: 170663 - DNA, 523 bp, Homo sapiens
  misc_feature: GYAE6OF01EAUGN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatctgggacacactttccaccctcaccatacaatacgcctggaagctagaagatgctgactaacttattactgtcatcaagtacgtactactttaccactaagtgatcctaccttcggaccaagggacacgactaggaacgtaattaaacgaatggtacgctacgcaccatctgtcttacc

SEQ ID NO: 170664 - DNA, 497 bp, Homo sapiens
  misc_feature: GYAE6OF01EPN6M.27.78.H01.1.454.CMB.1.raw
  modified_base (388)..(388): a, c, t, g, unknown or other
  misc_feature (388)..(388): n is a, c, g, or t
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaanctagaagatgctgacctaacttattactgtcatcagatactactttaccncagtgatcacctcggcaaggacacgactgganataaacgactgtgctgacacntctgtc

SEQ ID NO: 170665 - DNA, 521 bp, Homo sapiens
  misc_feature: GYAE6OF01D1Y7K.27.78.H01.1.454.CMB.1.raw
  modified_base (450)..(450): a, c, t, g, unknown or other
  misc_feature (450)..(450): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttccaccctcaaccatcaatacgcctaggaagctagaagatgcctgacctaacttattactgtcatcagtagtactactttacctctaagtnactcaccttcggaccaagggaccacgactaggagtaattaaacgactgtcgactcgacaccactctgttcc

SEQ ID NO: 170666 - DNA, 495 bp, Homo sapiens
  misc_feature: GYAE6OF01DX3ZX.27.78.H01.1.454.CMB.1.raw
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgaggttcagtggcagtggatctgggacacatttcaccctcaccatcaatagcctggaagctagaagatgctagctaacttattactgtcatcagagtactactttacncaagtnatcaccttcgccaaggacacgctaggagacttaaagactgtgctgcacatctgtctac

SEQ ID NO: 170667 - DNA, 528 bp, Homo sapiens
  misc_feature: GYAE6OF01DA80V.27.78.H01.1.454.CMB.1.raw
  modified_base (229)..(229): a, c, t, g, unknown or other
  misc_feature (229)..(229): n is a, c, g, or t
  modified_base (450)..(450): a, c, t, g, unknown or other
  misc_feature (450)..(450): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagacttttcagtctgtgactccaaagganaaagtcaccatcacctgccgggccagtcagagcgttggtagtagcttacactggtaccagcagaagccaggtcagtctccaaagctcctcatcaagtatcgcttccagttccttctcgacgggtcccctcggacggttcagtgcaggtggatcgtgggacacgtatttccaccctcaccatacaatacgcctggaagcgtagaagatgctgcctaacgttnttactgtctatcagtacgtacttacttaccnctaagtgtactcaccttcggacaacggtacacgatggagagtaaacg

SEQ ID NO: 170668 - DNA, 537 bp, Homo sapiens
  misc_feature: GYAE6OF01B8LJC.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcctccaaagcctcctcatcaagtatgccttcccagttcccttctcgacggggtcccctcggacggttcaggtggcaggtggatcgtgggactactatttccaccctcacccatacaatacgcctaggaagctagaagatgctgctaacttattactgtcatcagacttacttaccttaccataagtgatcctaccgttcggaccaacgggacacgatggaagtactaaacgg

SEQ ID NO: 170669 - DNA, 495 bp, Homo sapiens
  misc_feature: GYAE6OF01BQ3E6.27.78.H01.1.454.CMB.1.raw
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcctctcgaggttcagtggcagtggatctgggacacatttcaccctcaccatcaatagcctggaanctgaagatgctgcaacttattactgtcatcagatactactttacncaagtnatcaccttcgccaagggcacgactggacgtattaaacgactgtggctgcaccatctgttacc

SEQ ID NO: 170670 - DNA, 571 bp, Homo sapiens
  misc_feature: GYAE6OF01CE82U.27.78.H01.1.454.CMB.1.raw
  modified_base (196)..(196): a, c, t, g, unknown or other
  misc_feature (196)..(196): n is a, c, g, or t
  modified_base (332)..(332): a, c, t, g, unknown or other
  misc_feature (332)..(332): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccaggggtgaaattgtgctgactcagtctccagactttcagtctgtgactccaaaggngaaagtcaccatcacctgccgggcagtcagagcgttggtagtagcttacactggtaccagcaagaagccaggtcagtctccaaagcctcctcatcaagtatgccttcccagttccttctcgacggggtcccctcgnggttcagtggcagtggatcgtgggacactactttccaccctcaccatcaatacgcctagggaactctagaagtatcgctagtacctaacgttacttactgtacatcaagtacgttaccttactttacctataagtgtactcaccttcggaccaaagggaccacgacgtaggaacgtaacgttaaaccggacgttggtacggtactacggacctaccctagttccgttgttccttacccg

SEQ ID NO: 170671 - DNA, 536 bp, Homo sapiens
  misc_feature: GYAE6OF01EBI2Y.27.78.H01.1.454.CMB.1.raw
  modified_base (427)..(427): a, c, t, g, unknown or other
  misc_feature (427)..(427): n is a, c, g, or t
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggatcttaaaagaggttctttctctgggatgtggcatgagcaaaaactgacaaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttccagtccttctcacgggtcccctcgaggttcagtgcagtggatcgtgggacactatttccaccctcaccatcaatacgcctggaagctagaagntgctgactaacttattactgttacatcagtagttacttacctttacctataacgtnaactcgtacccgttccggaccaagggaccacgaanggtagaagttaaaaccgg

SEQ ID NO: 170672 - DNA, 533 bp, Homo sapiens
  misc_feature: GYAE6OF01CDR9I.27.78.H01.1.454.CMB.1.raw
  modified_base (441)..(441): a, c, t, g, unknown or other
  misc_feature (441)..(441): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtcccttctcacggggtcccctcgacggttcagtgcagtggatctgggacacatttcaccctcacccatcaatacgcctaggaagctgaagatgctgctaattnttactgtcatcagtagtactactttacctcaagtgattccaccttacggacccaaagggaccaacggaacgtcgggaagtagttaaaaccgg

SEQ ID NO: 170673 - DNA, 572 bp, Homo sapiens
  misc_feature: GYAE6OF01EQ85P.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggggtgaaattgtgctgactcagtctccagactttcagtctgtgactccaaaggagaaagtcaccatcacctgccggcagtcagagcgttggtagtagcttacactggtaccagcagaagccaggtcagtctaccaaagctcctcatcaagtatgcttcccagtccttctcgacgggtcccctgaggttcagtggcagtggatcgtggacactatttccaccctcaccatacaatagcctaggaacgctagaagtatgctgactaacttattactgtcatcaagtacttactaactttacctactaagtgtaacttcctaacccgttaccgggaccaaacggggacctaaccggtacgtagggaacgtaaacgttaaaacggaacgttggtacggcttacggccctaacctattccttgtccctttaccg

SEQ ID NO: 170674 - DNA, 539 bp, Homo sapiens
  misc_feature: GYAE6OF01D65JI.27.78.H01.1.454.CMB.1.raw
  modified_base (387)..(387): a, c, t, g, unknown or other
  misc_feature (387)..(387): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttcaccctcaccatcaatagcctggaacnctagaagatgctgactaacttattactgtcatcagtacgtactacctttacctcgtaacgtgacttcaccttcggaccaagggaccacggactagggaacgtaattaaacggacttggtaggcctagacccaacctacgtccttggttaccc

SEQ ID NO: 170675 - DNA, 509 bp, Homo sapiens
  misc_feature: GYAE6OF01BX8XT.27.78.H01.1.454.CMB.1.raw
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggagtagcttacactggtaccagcagaagccaggtcagtctccaaagctcctcatcaagtatgcttcccagtccttctcacggggtcccctcgaggttcagtggcagtggatctggacacatttcaccctcacatcaatagcctggaagctagaagntgctagcaacttattactgtcatcaagagttaactactttacctacaagtgaatcaccttcggaccaaagggaccacgactaggagacttaaacgaactgtgctgcacatctgttctc

SEQ ID NO: 170676 - DNA, 563 bp, Homo sapiens
  misc_feature: GYAE6OF01EJI8O.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacgggtcccctcgaggttcagtggcaggtggatcgtgggacacgtactttcaccctcaccatacaatacgcctaggaacgctagaagatgctgactaactttattactgtcatcagtagttaccttactttaaccactaagtacgtactacctaccgttacggaccgaacgggacctacggtactaggaagtaaacttaaacggtaacgtggtacggctacggaccaaccctattccttgttcttacccg

SEQ ID NO: 170677 - DNA, 704 bp, Homo sapiens
  misc_feature: GYAE6OF01CSS7Y.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggttctgctgctctaggttccagcctccgagggtgaattgtgctgactcagtctcagtactttcagtctgtgactaccgaaaggagaagtcacatcaccgtggccggcaggtcagtgtacgttggtagtacgtcttacgacgtggtaccagctagagccgaggtcagtctaccaagtcctctcacgtacaagttatcgcttacccgagttaccttcgtccggtacgggtcccctaggtacgttcgaacgtggtaccgtaggtcggtacgttcggtagggtacctacgtactttaccacccgttacacctagttacaacgttcgaccgtaggaacgttactacggtaactcgtacgtacgttacgtaccttaacgttacgttacgtacggttacctacgttacgtaaacggttacgttacccgtttaacttttaaccgacgttaacggttaccgtaacgtttacccgtacccggttacggtaccgtaaaccgggtaccaacggttaccggtacgtaacggttaaaccgttaaacggtcgttacgggttccgtacggtacgtaccgtacgttacgttcgttcgtcccgtttaaccgg

SEQ ID NO: 170678 - DNA, 549 bp, Homo sapiens
  misc_feature: GYAE6OF01CPP6E.27.78.H01.1.454.CMB.1.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (537)..(537): a, c, t, g, unknown or other
  misc_feature (537)..(537): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttaggtagtagcttacactggtaccagcagaagccaggcagtctaccaaagctcctcatacaagtatcgccttcccagttcctctacgacgggtccctcgaggttcaggtggcagtggatcgtaggacactattacccaccctcaaccatacaagtagcccgtaggaacncgtagaaagngtgctacgactaatttactactgacatacagtaactactactttacanaatnacnctaccgtcggaccaagggcacggaacgtggaacgtaagttaaacgacgtggtcgcgtacgaccaaccttntccgtgttaccc

SEQ ID NO: 170679 - DNA, 548 bp, Homo sapiens
  misc_feature: GYAE6OF01BFJ3Z.27.78.H01.1.454.CMB.1.raw
  modified_base (229)..(229): a, c, t, g, unknown or other
  misc_feature (229)..(229): n is a, c, g, or t
  modified_base (455)..(455): a, c, t, g, unknown or other
  misc_feature (455)..(455): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctcaaagctcctcatcaagtatcgcttccagtccttctcgacgggtccctcggagttcagtggcaggtcgatcgtgggactactatttccaccctcaccactacaatacgcctaggaacgctagaagatgctagactaactttattacgtntactatacagtacgtaccttactttaccactaagtctatccgtacccttcggacctaaacgggacacgtagaggtaagtaacgttaaaaccgg

SEQ ID NO: 170680 - DNA, 504 bp, Homo sapiens
  misc_feature: GYAE6OF01BK8FS.27.78.H01.1.454.CMB.1.raw
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatacgcctggaagctgaagatgctgcaacttattactgtcatcagacgttactactttacctacaagtgtatcaccttcggaccaagggacacgactaggagacttaaagactgnggctgcacatctgtcttac

SEQ ID NO: 170681 - DNA, 536 bp, Homo sapiens
  misc_feature: GYAE6OF01DJKCK.27.78.H01.1.454.CMB.1.raw
  modified_base (454)..(454): a, c, t, g, unknown or other
  misc_feature (454)..(454): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcgacgggtcccctcgaggttcagtgcagtggatcgtgggacacatttccaccctcaccatcaatacgcctaggaacgctagaaagtatgactgactaacttattacctgtcatacagtagttactactttaccacaagtnactcaccttcggaccaaggacacgtacgtaggaagtaaattaaacgaacttggtacgacttgaccacctactcgtgttaccc

SEQ ID NO: 170682 - DNA, 558 bp, Homo sapiens
  misc_feature: GYAE6OF01C9DI9.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgcttcccagtccttctcgacgggtcccctcggagttcaggtggcaggtggatcgtgggacactactttccaccctcaaccatacaatacgcctaggaacgctagaagatgctagactaactttattactgtacatacagtacgttacttactttacactaagtgtatcctaccttcggacctaagggacctacggacgtgggaagtaaacgttaaacgaacgttggtacggctacggacctaacattcttcgtctttaccg

SEQ ID NO: 170683 - DNA, 578 bp, Homo sapiens
  misc_feature: GYAE6OF01DZH4N.27.78.H01.1.454.CMB.1.raw
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactaccaaaggagaaagtcaccatcacctgccgggccagtcagagtcgttggtagtagcttacactggtaccagcagaagccaggtcagtctccaaagctcctcatcaaagtatgtcctttcccacgttccctttctccgacggggttccccctcggacggttcaggtcggcaggtggtatcgtagggacactattccaccctcaccatcaatacgcctaggaacgtcgtagaagagtgtctagtactaacttnttactgtacatcaagtacttaacttacttacctacgaagttntactacctaccgtcggaccgtaacggactaacgacgtaggaacgtaacgttaaacggacttgggtagcctacgaccacgtatccttcgtccttaccg

SEQ ID NO: 170684 - DNA, 676 bp, Homo sapiens
  misc_feature: GYAE6OF01C1V5P.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtcccagacttctatctgtgactaccaaacggaaggaaagtacaccaactcacctcgccgggccgacgtcgagagcgttggtaggtagtcttactactggtaccgagacacgaagaccgacggtacgacgtacgtaccaaacgacctcctccatactaagtaatcgccttccctacgtcctttccttccgtaccggggtccccgttccggtacggttcgtacggtcggcgacgtggtacgtcgtacgggacgaactactttacctaccctacccacctaactacaactacgccgtacgggaagtctgaaagattcgctacgactaaacctttatttacctacggtcaactacgtaagtaacgtttaccctttaaccttttaccctacgaaggttcgtacttccctaacccgtttcgggaacccggaaagggaaccctaacgtaccggtagggaagtaaacgttaaaaccggtactggtcgggactcgaccaacctattcttcgtctttccacg

SEQ ID NO: 170685 - DNA, 497 bp, Homo sapiens
  misc_feature: GYAE6OF01D53MD.27.78.H01.1.454.CMB.1.raw
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatcaatagcctggaagctgaagatgctgcaacttattactgtcatcagagtactactttacctctaagtnatcacttcggacaaggacacgactggatattaaacgactgtgctncacatctgtc

SEQ ID NO: 170686 - DNA, 527 bp, Homo sapiens
  misc_feature: GYAE6OF01BRHB0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgagttcagtggcagtggatctgggacacgatttccaccctcaccatacaatacgcctggaacgctgaagtatgctgactaacttacttactgtcatcagtagtaccttacttacctacaagtgattccaccgttcggaccaacgggacacgacgtaggagtaagttaaacgaacgtgtggtactgacactatctcgtcttacg

SEQ ID NO: 170687 - DNA, 546 bp, Homo sapiens
  misc_feature: GYAE6OF01DX1WI.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagctcctcatcaagtatgcttcccagtccttctcgacggggtcccctggtaggttcagtggcagtggatcgtgggacactatttccaccctcaccatcaatgccgtaggaagcgtgaagatgctagactaattacttactagtcatcaagtacgttaactactttacctataagtcatcaccttacggaccaagggaccaacgacgtaggaacgtaatttaaacggactaggtcggacgttcgactaccctaattcctgttacc

SEQ ID NO: 170688 - DNA, 537 bp, Homo sapiens
  misc_feature: GYAE6OF01EY1W7.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctaccaaagcctcctcatcaagtatgccttccagtccttctcgacgggtcccctcgacggttcagtggctaggtggatcgtgggacactactttcaccctcaccatacaatacgcctggaagctagaagatgctgactaacttattactgtactatcagtacgtacttactttaccactaagtcatctacccgttcgaccgaagggaccacgagtaggagtaacgtaaacgg

SEQ ID NO: 170689 - DNA, 527 bp, Homo sapiens
  misc_feature: GYAE6OF01A62ZE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcacccctcaccatcaatacgcctggaacgctagaagatgctgactaacttattactgtcatcagtagttaccttactttacctctaagtgtatctaccttcggaccgaagggcacgacgtaggaacgtaagttaacgaagtcgtaggctcgacactatcttgttctaccg

SEQ ID NO: 170690 - DNA, 554 bp, Homo sapiens
  misc_feature: GYAE6OF01BE4HV.27.78.H01.1.454.CMB.1.raw
  modified_base (390)..(390): a, c, t, g, unknown or other
  misc_feature (390)..(390): n is a, c, g, or t
  modified_base (446)..(446): a, c, t, g, unknown or other
  misc_feature (446)..(446): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcgacgggtcccctcgacggttcaggtggcagtggatcgtggacactatttcaccctcaccatcaatagcctaggaanctagaagatgctagactaacttattactgtcatcagtacgtacttaacttacctanaagtgtactactaccgttacggaccgtaagggaccacgaacgtaggtaacgtaacttaaacggaacttggtacgtacgtcggacccaaccgtacttcgttcgttaccc

SEQ ID NO: 170691 - DNA, 549 bp, Homo sapiens
  misc_feature: GYAE6OF01AD7OC.27.78.H01.1.454.CMB.1.raw
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacgggtcccctcgagttcagtggcagtggatcgtgggacacgatttcaccctcaccatcaatagcctggaanctgaagatgctgactaacttattactgtacatcaagtacgtacttactttacctacaagtgactcctaccgttacggaccgtaagggaccaacggaacgtaggaacgtaaagttaaacggaactaggtacggacgttacgacacccattccgtgttaccc

SEQ ID NO: 170692 - DNA, 570 bp, Homo sapiens
  misc_feature: GYAE6OF01AO2RS.27.78.H01.1.454.CMB.1.raw
  modified_base (179)..(179): a, c, t, g, unknown or other
  misc_feature (179)..(179): n is a, c, g, or t
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccggccagtcagagcgttggtagtagcttacactggtaccagcagaagccaggtcagtcctaccaaagcctcctcatcaagtatcgccttccagttccttctcgacggggtcccctggaggttccaggtcggctaggtgactcgtagggacactactttccaccctcacctatacaatacgcctaggaacncgtagaagtagtcgactcgaccttaactttagttactagtctatacagtacgtaccttactttacctataacgtgtactcctaccgttacggacccgtaaacgggaccaacggagtaggtaagtaagtaaacg

SEQ ID NO: 170693 - DNA, 557 bp, Homo sapiens
  misc_feature: GYAE6OF01D0903.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgagttcagtgcagtggatcgtgggacactattccaccctccaccatacaatacgcctaggaagctagaagatgctgactaacttattactgtcatcagtagttaaccttactttaccctataacgttgtacttccgtacccgttaccggacccgaaacgggtaccaaccggacgttacgggaacgtaagttaaaacccgg

SEQ ID NO: 170694 - DNA, 711 bp, Homo sapiens
  misc_feature: GYAE6OF01E559T.27.78.H01.1.454.CMB.1.raw
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccgaaaggagaaacgtcaccatccaccgtcggccggccagtcagagtcgttggtagtagtccttacacgtcggtaccagacgaagaagccgaggtcacgtcctaccaaacgcctcctacactacaagtactcgtccttccctacgttccgttcgtaccggtacgggtccccgtcggtacggttcgaggtcggacgtaggtcggacgtcggtacggtactaccgtactttccctaaccctaccaacctatacaacgtacgtcgtaggacgtacgtagaagtntcgacgtacgtacttaactttacgttacttacgtactacgtacgtaacgttaaccgttaacctttaaccgtttaaccgtaacgtacgttacgtaaccttacccgttacccggttacggaaccggtaaacgggaccgtaacggtaacgtaacgggtaaacgttaaacggttaaaccgtacggtcgggttaccgacgttaccgtaacccgtaccttacgttccctttcgttaccctttacccg

SEQ ID NO: 170695 - DNA, 627 bp, Homo sapiens
  misc_feature: GYAE6OF01B0C49.27.78.H01.1.454.CMB.1.raw
  modified_base (194)..(194): a, c, t, g, unknown or other
  misc_feature (194)..(194): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtgaaattgtgctgactcagtctccagactttcagtctgtgactcaaagganaaagtcacatcacctgccggcagtcagagtcgttggtagtagcttacacgtggtaccagcagaagccaggtcagtctaccaaagcctcctcatcaagtatgccttccagtccttctcgacgggtcccctggacggttccagtcggcaggtggacgtcgtagggactacgtactttcaccctcacctatacaagtacgcctaggaacgctagaagtacgtagcctagaacctaactttattaccgtgtactactcgtaagtacgttaacctttaacctttaccgtactaagttacgtaactacccgtaaccgtttccgggaccgtaaacgggtaccgaaccggtacgttacgggaaagtaacgttaaaaccggacgttcgggtacggtccttacggaccctaaccgtaagtttccgttacgttcctttaacccg

SEQ ID NO: 170696 - DNA, 581 bp, Homo sapiens
  misc_feature: GYAE6OF01CMYIS.27.78.H01.1.454.CMB.1.raw
  modified_base (402)..(402): a, c, t, g, unknown or other
  misc_feature (402)..(402): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaaagtcaccatcacctgccgggccagtcagagcgttggtagtagcttacactggtacagcagaagcaaggtcagtctccaaagctcctcatcaagtatgcttcccagtccctttctccgacggggtcccctcgacggttcagtggcagtggatcgtggacactatttccaccctcacatacaatacgcctaggaacgtctagaagntcggctgactaactttatactgtacatcaagacgtttaacttaactttacctataacgtcgtacttacctaccgttaccggacccgaaagggtaccaacggtacgtagggaaacgttaaacgttaaaacggaacttcggtacggtactacgtaccaacctatttctgtttccgttaacc

SEQ ID NO: 170697 - DNA, 548 bp, Homo sapiens
  misc_feature: GYAE6OF01EXDWB.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggggcgatgagcaaaactgacaagtcaaggcaggaagatgttgccatcacaactcattgggtttctgctgctctgggttccagcctccgaggggtgaaattgtgctgactcagtctccagactttcagtctgtgactccaaaaggagaaagtcaccatcacctgccgggccagtcagagcgttggtagtagcttacacgtggtaccagcagaagccaggtcagtctccaaagctcctcatcaagtatgcttcccagtccttctcgacggggtcccctcgtaggttcagtggcagtggatctgggacactactttcaccctcaccatcaatacgctaggaagctagaagatgctgactaacttattactgtcatcanacgttactacctttacactaagtgtacttccaccgttacggaccaagggaccacgacgtagggaactaagttaaacggaacttggtcggactcggaccaacctacttcgtgttaccc

SEQ ID NO: 170698 - DNA, 646 bp, Homo sapiens
  misc_feature: GYAE6OF01A1VRW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctacggtaggttcaggtggccaggtggatcgtgggacactatttccacccctcaccatcaatacgccttaggaacgtctagaagattgctgactaactttattactgtcattccaagtacgttaacttacttttacctacgtaaagttcgtaacttaccgtaaccccgtttaccgggaacccgtaaacgggggtaacccaaccgggtaaaccggtaaggggttaaacggtaaaacgtttaaaacccggtaaacgttacgggttacgggtaccgttacggtaaccctaacccgtaagtttcccgtttaaggttccctttaaccc

SEQ ID NO: 170699 - DNA, 571 bp, Homo sapiens
  misc_feature: GYAE6OF01B674S.27.78.H01.1.454.CMB.1.raw
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagcaggtcagtctaccaaagcctcctcatcaagtatcgccttcccagtcctctcgacgggtcccctgaggttcagtggcagtggatcgtgggacactactttcacccctcaccatcaatacgcctggaanctagaagatgactgactaacttattacctgtactatacagtacgttaaccttactttaacctacaagttgacttccgaaccgttccggaccgaaacgggacctaacggtaacgtacggtaaacgtaacttaaaacggtaactcgggtacgactacgaccaccctagttccgtgttacccc

SEQ ID NO: 170700 - DNA, 616 bp, Homo sapiens
  misc_feature: GYAE6OF01BRFM5.27.78.H01.1.454.CMB.1.raw
  modified_base (293)..(293): a, c, t, g, unknown or other
  misc_feature (293)..(293): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtntgccttcccagtccttctcgacgggtcccctcgaggttcagtggcaggtggatcgtagggacacgtatttccaccctcaccatacaatacgccgtaggaacgtcgtagaagatgactgactaactttattactgtactatcaagtacgttaacctactttacctacgtaacgttcgtaacttacctaaccggtttccggaacccgaaacgggtacccaaccggtacgtaacgggtaaacggtaaacgttaaaaccggaaacgttcgggtacggtaccgttacggaccctaaccgtaacgtttccgttcgttccgtttaacccg

SEQ ID NO: 170701 - DNA, 602 bp, Homo sapiens
  misc_feature: GYAE6OF01DPRYC.27.78.H01.1.454.CMB.1.raw
  modified_base (353)..(353): a, c, t, g, unknown or other
  misc_feature (353)..(353): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgcccgggccagtcagagcgttggtagtagcttacactggtaaccagcaagaagccaaggtcagtctaccaaagctcctcatcaagtatcgcttcccagtccttactcgacggggtcccctcgaggtcagtggcagtgatcgngggacacgtattcaccctcaccatacaatacgcctaggaanctaggaacgatcgctaggactaactttattactcgtacattcaagtaacgttactaacgttttaacctcgaagttatacttaccaacctttcgggaccgtaaagggacctaacggaccgttagggaaacggtaactttaaaacgggaaccgttggtaacgggtccttacgggaaccctaacctaagttcccgtcgttttccgttaacc

SEQ ID NO: 170702 - DNA, 531 bp, Homo sapiens
  misc_feature: GYAE6OF01CDZNP.27.78.H01.1.454.CMB.1.raw
  modified_base (393)..(393): a, c, t, g, unknown or other
  misc_feature (393)..(393): n is a, c, g, or t
  modified_base (450)..(450): a, c, t, g, unknown or other
  misc_feature (450)..(450): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgccttcccagtccttctcacggggtcccctcgaggttcagtggcagtggatcgtgggacactactttccaccctcaccatacaatacgcctaggaanctagaagatgctagactaatttattactgtcatcagagtactactttacactaagtntatcacttcggccaaagggacacggactagggagtaattaaacgaacgtggtaggactcggacaacctatcctgttcttac

SEQ ID NO: 170703 - DNA, 551 bp, Homo sapiens
  misc_feature: GYAE6OF01CBISJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacactggtaccagcagaagccaggtcagtctccaaagctcctcatcaagtatcgccttcccagttcccttctcgacggggtcccctcggaggttcagtggcagtggatcgtggacactactttccaccctcaccatcaatacgcctggaagctagaagatgctgactaattatactgtcatcagagttacttacttacctataacgtgtacttccaccgttaccggaccaagggactacggactaggaacgtaacgttaaacgacgttggacggtactacggacctacctatccttgtcctttaccg

SEQ ID NO: 170704 - DNA, 584 bp, Homo sapiens
  misc_feature: GYAE6OF01ECWLR.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccggccagtcagagcgttggagtagcttacacgtggtaccagcagaagccaggtcagtctccaaagctcctcatcaagtatgcttccagtccttctcgacgggtcccctcgagttcagtggcaggtggatcgtgggactactactttccgaccctcaccataccaatacgaccgtaggaacgcgtagaacgatcgtctcgactaactttattaactgtactatacgagtacgttacttaactttaacctcgaagttgaacttacacccgttcgggaaccgtaagggaccgaacgtacgtagggtaacgtaacgttaaaacggaagtcgggttacgacgtacggaccctaaccgtattccgtcgtttaccc

SEQ ID NO: 170705 - DNA, 630 bp, Homo sapiens
  misc_feature: GYAE6OF01CRSHG.27.78.H01.1.454.CMB.1.raw
  modified_base (312)..(312): a, c, t, g, unknown or other
  misc_feature (312)..(312): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatctcctactcttcctcncgggtcccgtccgtacggttcgtacgtaggcgagtggtagtacgttgggacggtacactttacctacccctaccctacccaactactaactaacgaccgtcggtaacggactgaacgagtagtctgtacgtaacttaactttacttacgttactactacgtacgaagttacttaacctttaccttacctaagtacgtacttacaccctttaccggtaccgtaacgggaacgaccgtaacgtacggtaaggaacgttaaaacgtaaacgtaggttcggacgtacgtaccaccgtaacttcgtcgttcgttcttaacccg

SEQ ID NO: 170706 - DNA, 585 bp, Homo sapiens
  misc_feature: GYAE6OF01CZ6W2.27.78.H01.1.454.CMB.1.raw
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagtactttcagtctgtgactcaaaggagaaagtcaccatcacctgccggcagtcagagcgttggtagtagcttacactggtaccagcaagaagccaggtcagtctccaaagctcctnatcaagtatgccttcccagtccttctcacgggtcccctgagttcagtgcagtgatcnggacactagttcaccctcacccatacaaatacgacccgttaggaacgtcgttagaagtatgaccttggaccttaaacgttaactttacgtagtacctaatcgtaagtaacgttaacctttaactttacctactaaggttacataccctacgtttaccggactaacgggtaacaccgacgtaggtaacgtaacgttaaacgacgtggtacggctacggacctaacctattccgtgtctttacccg

SEQ ID NO: 170707 - DNA, 571 bp, Homo sapiens
  misc_feature: GYAE6OF01BTV2H.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgccttccagtcccttctcgacggggtccccctcggtacggttcagtggcaggtggatcgtgggacactactttccaccctcaccatcaatacgcctaggaacgctagaagatgctgacctaacttacttacgtgtactatcaagtacgttaacttacctttacctactaaagtcgtaactcctacccgttacgggaacccgaagggtaccaacggactagggaacgtaacgttaaaaccgg

SEQ ID NO: 170708 - DNA, 637 bp, Homo sapiens
  misc_feature: GYAE6OF01DHXCN.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccgaaagganaaagtcaccatcacctgccgggccagtcagagtcgttggtagtagcttacacgtgtaccagcagaagccaggtcagtctaccaaagcctcctcatcaagtatcgccttcccagtccttctcgtacgggtcccctgtacggttcagtggctaggtggactcgacgggacactacgtttccaccctcgaaccatacgaactacgccgttaggaacgtacgttaggaaagtctaggtacctcggtaacctaaacttttatttacgtcgtacctagttccgtaaagtaggtttaacccttaaacgttttaccctaagtaaggttacgtaaccttaccgtaaccctttccgggaacctaaacgggacctaaccgacgtaggtaaacgtaacgttaaaacgacgtggtacggtacctgtaccacgtatcccgttagttccttaccg

SEQ ID NO: 170709 - DNA, 513 bp, Homo sapiens
  misc_feature: GYAE6OF01CK0EE.27.78.H01.1.454.CMB.1.raw
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaaagctcctcatcaagtatgcttcccagtccttctcagggtcccctcgaggttcagtggcagtggatctgggacacatttcaccctcaccatcaatagcctggaagctgaagatgctgacaactttatactgtcatcagagtactactttacctcaagtnatcaccttcggaccaagggaccacgacgtaggaagtattaaacgaacttggcggactgcaaccatctgtcttacg

SEQ ID NO: 170710 - DNA, 516 bp, Homo sapiens
  misc_feature: GYAE6OF01AEP6P.27.78.H01.1.454.CMB.1.raw
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccataacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatacaatagcctggaagctagaagatgctgactaacttattactgtcatcagtatactactttacctcaagtgactcaccttcggaccgaagggaccacgtactaggagagttaaacgactgtggctgacacatntcgtctntaccg

SEQ ID NO: 170711 - DNA, 566 bp, Homo sapiens
  misc_feature: GYAE6OF01B33FV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtcccttctcgacggggtcccctcgaggttcagtggcagtggatcgtgggacacgactttccacccctcacccatcaaatacgcctaggaacgctagaagtatcgctgctaactttattactgtctatcaagtactacttactttacctactaagtcacttacctaccgtttccgggaccaaagggaccacggtacgtaggaacgtaacgttaaacggacgttggtacggcctagacccaccgtattcttcgttccttaccg

SEQ ID NO: 170712 - DNA, 526 bp, Homo sapiens
  misc_feature: GYAE6OF01BEB81.27.78.H01.1.454.CMB.1.raw
  modified_base (319)..(319): a, c, t, g, unknown or other
  misc_feature (319)..(319): n is a, c, g, or t
  modified_base (430)..(430): a, c, t, g, unknown or other
  misc_feature (430)..(430): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagctcctnatcaagtatgcttccagtccttctcacgggtcccctcgacggttcagtggcagtggatcgtgggacactatttccaccctcaccatcaatacgcctaggaacgctaggaanatgctgactaacttatactgtacatcagtacgtactacttacctataagtnatcaccgttcggaccgaagggacaacgactggaagtaagtaaacg

SEQ ID NO: 170713 - DNA, 577 bp, Homo sapiens
  misc_feature: GYAE6OF01A68DM.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtcccttctcgacggggtcccctcgaggttcagtggcagtggatcgtgggacactatttccaccctcaccatacaatcgcctaggagtctagaagatgctgactaacttattactgtactatctaagtacgttaacttacctttacctacgtaagttcgtactccgtaccgttcggacccgaagggtaccacggacgttagggaacgttaagttaaacggaacttacgggtcgggtacctaggacccaaccgtacttcgttcgtttaccc

SEQ ID NO: 170714 - DNA, 597 bp, Homo sapiens
  misc_feature: GYAE6OF01EUE7Z.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagctcctcatcaagtatgccttcccagtccttctcgacgggtcccctcggacggttcagtcggcaggtggatcgtgggacacgtactttcaccctcacctatcaaatacgcctaggaacgtctagaagtactgacttgacctaaactttaattactggtacctactcaagtaacgttaaccttaaccgttttacctactaaacgttgaacttaccgaccgttcgggacccgaaacgggtacctaacggaccgtagggaacgtaatttaaaaaccgacttcggtacggtctacggcctaaccgagttccttcggtcttaccg

SEQ ID NO: 170715 - DNA, 559 bp, Homo sapiens
  misc_feature: GYAE6OF01CUM8L.27.78.H01.1.454.CMB.1.raw
  modified_base (426)..(426): a, c, t, g, unknown or other
  misc_feature (426)..(426): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccgggccagtcagagcgttggtagtagcttacactggtaccagcaagaacgccaggtcagtctacaaagctcctcatcaagtatgcttccagtccttcgtcgacgggtccctggtagttccagtggcaggtggatcgtggacacgtacttccaccctcacatacaatacgcctaggaanctagaacgtatgacgtagactaactttactactgtacatacaagtaacgttaccttacttacctactaagtcgtatacctaccgttaccggaccgtaaacgggaccacgaacgtggaaagtaacgttaaacgg

SEQ ID NO: 170716 - DNA, 518 bp, Homo sapiens
  misc_feature: GYAE6OF01CVVAY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatctgggacacgatttcaccctcaccatcaatacgcctggaacgctagaagatgctgacaactttatactgtcatcagtagtaccttactttaacctcaagtgactcaccttcggccaagggccacggactgggaacgtagttaaacgacttgtcggctgccacatctgtcttccg

SEQ ID NO: 170717 - DNA, 510 bp, Homo sapiens
  misc_feature: GYAE6OF01DOY0D.27.78.H01.1.454.CMB.1.raw
  modified_base (380)..(380): a, c, t, g, unknown or other
  misc_feature (380)..(380): n is a, c, g, or t
  modified_base (500)..(500): a, c, t, g, unknown or other
  misc_feature (500)..(500): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctgagtcagtgcagtggatctgggacacatttcaccctcaccatcaatagcctggaanctagaagatgctgactaacttattactgtacatcagagtaccttactttaccataagtgatcctacttcggaccaacgggacacgactggaagtaacttaaacgactgacggctagcacntctgtcttac

SEQ ID NO: 170718 - DNA, 559 bp, Homo sapiens
  misc_feature: GYAE6OF01AI4RN.27.78.H01.1.454.CMB.1.raw
tcagagcgtcgtctcacgaccggtgctcgatttagtgtgagtagtttggggtttggggagtgagcaaaactcgacgaagtcaaggcgaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccagggtcagtctccaaagctcctcatcaagtatgccttcccagtccttctcgacggggtcccctcgtaggttcaggtggcagtggatcgtgggacacgtatttccaccctcacctatacaatacgcctacgggagcctagaagatgctgacctaattacttactgtcatcaagtacgtacttactttacctactaagtgtataccacctttcggaccgaaggcacggtacgtaggaacgtaacgttaaacgacgtcggtacgtcgtacgccacctaatctgttcttacccg

SEQ ID NO: 170719 - DNA, 540 bp, Homo sapiens
  misc_feature: GYAE6OF01C0IFW.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccggccagtcagagcgttggtagtagcttacactggtaaccagcagaagccaggtcagtctccaaagctcctcatcaagtatgcttcccagtccttctcacgggtcccctgacggttcagtggcaggtggtatcgtgggactactacttccaccctcacccatcaatacgccgtaggaacgcgtagaagatgctgactaacttattactgtacactcagtagtaccttacttacctataacgtgatccaccttcggaccaagggaccacgactaggaagtaagttaaaaccgg

SEQ ID NO: 170720 - DNA, 644 bp, Homo sapiens
  misc_feature: GYAE6OF01CMOIR.27.78.H01.1.454.CMB.1.raw
  modified_base (288)..(288): a, c, t, g, unknown or other
  misc_feature (288)..(288): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagcctcctnatcaaagtatgcttcccagtccttctcgagggtccccctgaggttcagtggcagtggatcgtgggacacgtatttccaccctcaccatcaaatagcctggaagctagaagatgctgactaactttattactgtacattacgaagtacgttaaccttaaccttttaaccctaactaaagttacgtaacttaccctaacccgtttacccgggacccgtaaaacggggaaccctaaaccggtaaccgttaggggaaacggttaaaacgtttaaaacccgggtaaaccgttagggttacgggtaccgttaacggtaccctaaacccgtatttacccgttcggtttacccttttaaccccg

SEQ ID NO: 170721 - DNA, 494 bp, Homo sapiens
  misc_feature: GYAE6OF01CE98K.27.78.H01.1.454.CMB.1.raw
  modified_base (431)..(431): a, c, t, g, unknown or other
  misc_feature (431)..(431): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatctgggacacatttcaccctcaccatcaatagcctggaacgctgaagatgctgacaacttattactgtcatcagagtactactttacncagtgatcaccttcggaccaagggacacgacgtgagataacgatgngntgcacatctgtnttc

SEQ ID NO: 170722 - DNA, 544 bp, Homo sapiens
  misc_feature: GYAE6OF01AT80H.27.78.H01.1.454.CMB.1.raw
  modified_base (460)..(460): a, c, t, g, unknown or other
  misc_feature (460)..(460): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccaggtcagtctccaaagctcctcatcaagtatcgccttcccagttccttctccgtacggggtcccctcggtacggttcaggtggcaggtggatcgtgggacactatttcaccctcacctatacaatacgcctaggaacgcgtagaagactgtctgactaacgttatactgtcatcaagtatacttacttaccatagtnactctacgttcgaccgaaggacacgtacgtaggaagtaacgttaacgacttggtacgactacgacacctatccgttgtcttacg

SEQ ID NO: 170723 - DNA, 525 bp, Homo sapiens
  misc_feature: GYAE6OF01DL0RQ.27.78.H01.1.454.CMB.1.raw
  modified_base (395)..(395): a, c, t, g, unknown or other
  misc_feature (395)..(395): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttccaccctcaccatcaatagcctaggagtctgaanatgctgcctaattattactgtcatcagagtacttacctttaccactaagtgactccaccgttcggaccaacgggacacgactaggaagtaattaaacggactggtagctgacctaccactcttgttaccc

SEQ ID NO: 170724 - DNA, 541 bp, Homo sapiens
  misc_feature: GYAE6OF01BW5S3.27.78.H01.1.454.CMB.1.raw
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcaggtgatctgggacactatttccaccctcaccatcaatacgcctggaacnctagaagatcgctgactaactttatactgtcatcaagtagttacttactttaccctcaaagttgacttcaccgttacgaccgaagggacacgtaacgtaggaacgtaagttaaacgacttggtaggcctacgaccaaccattcgtcgttacg

SEQ ID NO: 170725 - DNA, 498 bp, Homo sapiens
  misc_feature: GYAE6OF01AZCI2.27.78.H01.1.454.CMB.1.raw
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagatactactttacctcaagtnatcaccttcggaccaagggacacgactggaagtattaacgactgagctgccacatctgtctac

SEQ ID NO: 170726 - DNA, 571 bp, Homo sapiens
  misc_feature: GYAE6OF01B8MAZ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcctaccaaagctcctcatcaagtatcgccttcccacgttcccttctcgacggggtcccctcggtacggttcaggtgcgagtggatcgtgggacactactttccaccctcaacccatacaaatacgccctaggaacgcctagaacgtatcggcttagacctaacttacttactgtacataccagacgttaccttacttaccactaagtcgaactccgtacccgttcggaccctaagggccaacggataggaacgtaattaaaaccgg

SEQ ID NO: 170727 - DNA, 529 bp, Homo sapiens
  misc_feature: GYAE6OF01EEQB7.27.78.H01.1.454.CMB.1.raw
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcaggggtcccctgaggttcagtggcaggtggatcgtgggacactactttcaccctcaccatacaatacgcctggaanctagaagatgctgctaacttattactgtcatcagtacgtactactttaccnctaagtgatcacccgtttcggaccaaacgggaccaacggatgggaagtattaaaacgg

SEQ ID NO: 170728 - DNA, 540 bp, Homo sapiens
  misc_feature: GYAE6OF01DD6EI.27.78.H01.1.454.CMB.1.raw
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgaggttcagtgcagtggatcgtggacacatttcaccctcaccatcaaatacgcctaggaagcctagaagatgctagactaacttattactgtcatcagacgtactactttaccncaagtgtactacctaccttcggactaagggaccacgaccgtggaagtaacgttaaacgacgttgtcggtaccttcggacctaacctattcctgttcccttaccg

SEQ ID NO: 170729 - DNA, 533 bp, Homo sapiens
  misc_feature: GYAE6OF01DIBDD.27.78.H01.1.454.CMB.1.raw
  modified_base (338)..(338): a, c, t, g, unknown or other
  misc_feature (338)..(338): n is a, c, g, or t
  modified_base (415)..(415): a, c, t, g, unknown or other
  misc_feature (415)..(415): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctctcatcaagtatgcttcccagtccttctcgacgggtcccctcgaggttcagtggcngtggatcgtgggacactactttccaccctcaccatcaaatagcccttaggaacgctagaagatgctgactaactttntactgtcatcagacttacttactttacctctaagtgtatcctaccttcggaccaaagggaccaacgacgtaggaagtaattaaacgacttggtacgctacgcaaccattctgtccttc

SEQ ID NO: 170730 - DNA, 504 bp, Homo sapiens
  misc_feature: GYAE6OF01B274A.27.78.H01.1.454.CMB.1.raw
  modified_base (196)..(196): a, c, t, g, unknown or other
  misc_feature (196)..(196): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatcacctgccgggccagtcagagcgttggtagtagcttaacactggtaccagcagaagccaggtcagtctccaaagctcctcatcaagtatgcttcccagtccttctcacgggtcccctcgaggttcagtggcagtggatctgggacacatttcaccctcaccatcaaatacgcctggaanctgaagntgctgacaacttattactgtcatcagagtactactttacctnaagtgatcaccttcgaccaaggcaacgctaggagtaattaacgaactgtggctgcacatctgtcttac

SEQ ID NO: 170731 - DNA, 600 bp, Homo sapiens
  misc_feature: GYAE6OF01CTDID.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtatagcttacactggtaccagcagaagccaggtcagtctccaaagcctcctcatcaagtatcgcttcccagtcccttctcgacgggtcccctgacggttcagtgcaggtggatcgtaggactacgtatttccaccctcacctatcaactacgccgtaggaagcttaggaagatgctagtactaactttactactgtacatcaagtacgtaccttactttaacctactaaagtcgtactaccgtaaccgttccgggaccgtaaagggacctaacggaaccgttagggaaacgtaaacgtttaaaacgaacgttcggtacggtccttacggaccctaaccgtacgttcgttcggtttcctttaacccg

SEQ ID NO: 170732 - DNA, 535 bp, Homo sapiens
  misc_feature: GYAE6OF01EK1NI.27.78.H01.1.454.CMB.1.raw
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttccagtccttctcagggtcccctcgaggttcagtgctagnggatcgngggacactatttcaccctcaccatcaatacgcctgganctgaagntgctgctaacttattactgtcatcagacttacctactttacctactaagtgtactcacccgtttacggaccctaaacggggccaacggacctagggaagtaagttaaaaccgg

SEQ ID NO: 170733 - DNA, 709 bp, Homo sapiens
  misc_feature: GYAE6OF01DPQ4A.27.78.H01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtcctccagtactttcagtctgtgactccaaagganaagtcacatcacctgccggccagtcagagcgttggtagtacgcttacacgtggtaccagcaagaagccgaggtcacgtctaccaaagtccctactacactactaacgtctccgtccttacccgtacgtttcccgttaccgtaccgggtacccgggtttaccccgtacgggttacggttacgtagggtccgacgtaggttcggtacgttccgggtacggaacctacgtacctttaccccgacccttaccgaaaccctacgtaactaaacgtaccgtacgtaaggtaccgtacgtagaacgtacgtcggttacgtacgtaacctttaaacgtttaacgttacgttcctaacttacgtacgtaacgtaaccgtttaccttttaacctacccgtaataacggtctacctacccggttacgtaacccgggaaccgaacggtaaccgtaacgtaaggttacggtaaacgtaaacgttaaacccgg

SEQ ID NO: 170734 - DNA, 557 bp, Homo sapiens
  misc_feature: GYAE6OF01C6HKC.27.78.H01.1.454.CMB.1.raw
  modified_base (460)..(460): a, c, t, g, unknown or other
  misc_feature (460)..(460): n is a, c, g, or t
  modified_base (551)..(551): a, c, t, g, unknown or other
  misc_feature (551)..(551): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcacgggtcccctcgaggttcagtggcagtggatcgtgggacacgtacttccaccctcacccatcaatacgcttaggaacgtcgtagaagatgctacgactaactttattactgtcatacgagtacgtacttactttacctactaagtnactcctaccgttacggaccgaagggaccacgacgtaggaacgtaattaaaccgaacttggtaggtcctacggacctaacctattctcgttnttaccc

SEQ ID NO: 170735 - DNA, 521 bp, Homo sapiens
  misc_feature: GYAE6OF01AXA8Q.27.78.H01.1.454.CMB.1.raw
  modified_base (228)..(228): a, c, t, g, unknown or other
  misc_feature (228)..(228): n is a, c, g, or t
  modified_base (318)..(318): a, c, t, g, unknown or other
  misc_feature (318)..(318): n is a, c, g, or t
  modified_base (418)..(418): a, c, t, g, unknown or other
  misc_feature (418)..(418): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaagctcctnatcaagtatgcttcccagtccttctcacggggtccctcgagttcagtgcagtggatctgggacacactttcacccttcaccatcaatagccctaggaacnctagaagatgctgctaacttatactgtacatcagtacgtactacctttacctctaagtcattcaccttcggacccaagggaccacggactggagagttaaacg

SEQ ID NO: 170736 - DNA, 506 bp, Homo sapiens
  misc_feature: GYAE6OF01ADIB2.27.78.H01.1.454.CMB.1.raw
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcaccctcaccatcaatacgcctggaagctgaagatgctgctaacttattactgtacatcagagttactactttaccncaagtgacttcaccttcggaccaagggcacgactggagtacttaaacgactgtgctgccacatctgtcttc

SEQ ID NO: 170737 - DNA, 717 bp, Homo sapiens
  misc_feature: GYAE6OF01D7ACX.27.78.H01.1.454.CMB.1.raw
  modified_base (149)..(149): a, c, t, g, unknown or other
  misc_feature (149)..(149): n is a, c, g, or t
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
tcagagcgtcgtctcacgaccggtgctcgatttagtgtgagtagtttgggtttggggtagtgagcaaaactgaacaagtcaaggcaggaagatgttgccatcacaactcattgggtttctgctgctctgggttccagcctccaggggtnaaattgtgctgactcagtctcagtactttcacgtctgtgactccaaaggagtaaacgtcacctatcacctgccggccagtcagtagtcggttgggtataggtcttacacgtggtaccgaggcgaagaagccaggtcagtctacaagctccnatcaagtatcgtctccagtcctacncgtacggtccctcgngttccagtgcagtgactcgtcggactacgtactttaccgaccctactaccctatactaaattacgacccgttaggaacgtcgtaacgaacggtagtcggtactacggtaaccttaaaccgtttacgttaacgttcgttaccgtaacttaccggaagttaaccgttaaccttttaaccgttttaaccctaacgttaaaggttaccggttaactttacccgtaccccgtttaaccgggtaacccgtaaacgggtaaccgtaaccgggtaccggttaacgggtaaaccggtaaaccggttaaaacccgggtaacggttcgggtacggttaccggaccgtaaccgtacccgtaagttccgtttacggtcctttaaccccgg

SEQ ID NO: 170738 - DNA, 506 bp, Homo sapiens
  misc_feature: GYAE6OF01BKQAZ.27.78.H01.1.454.CMB.1.raw
  modified_base (229)..(229): a, c, t, g, unknown or other
  misc_feature (229)..(229): n is a, c, g, or t
  modified_base (392)..(392): a, c, t, g, unknown or other
  misc_feature (392)..(392): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctccaaagctcctcatcaagtatgcttccagtccttctcagggtcccctgaggttcagtgcagtgatcgtgggacacatttcaccctnaccatcaatagcctaggaagctagaagatgctgacaacttatactgtcagtcagtagtactacttaccataagtgatcaccttcggacctaaggacacgatggagagttaaacg

SEQ ID NO: 170739 - DNA, 638 bp, Homo sapiens
  misc_feature: GYAE6OF01AYJYI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggttctgctgctctgggttccagcctccaggggtgaaattgtgctgactcagtctccagactttcagtctgtgactaccaaaggagaaagtcaccatccacctggccggccagtcagagcgttggtagtagcttacactggtaccagcagaagccaggtcagtctaccaaagctcctcatcaaagtatcgcttcccagtacccttcgtcgacggggttcccctcgtacggttccaggtcggccgtaggtcggtactcgtagggtactaccgtactttaccgacccctacaaccctataccaatacgccgtacggaacgtctagaacgtagtgctagtactaactttacttaactagttaccacttacgtaagtacgttaccttaacttaccttacgtaaagttcgtaaccttacccgtacccgtttccggaaacccgtaagggtaacccgtaacggtaaccgtagggtaaacgtaaagttaaaacccggtaacgg

SEQ ID NO: 170740 - DNA, 532 bp, Homo sapiens
  misc_feature: GYAE6OF01D8AF5.27.78.H01.1.454.CMB.1.raw
  modified_base (456)..(456): a, c, t, g, unknown or other
  misc_feature (456)..(456): n is a, c, g, or t
  modified_base (519)..(519): a, c, t, g, unknown or other
  misc_feature (519)..(519): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaaagctcctcatcaagtatgcttcccagtccttctcaggggtcccctcgtaggttcagtggcagtggatcgtgggacacatttccaccctcaccatcaatacgcctaggaacgctagaagtatgctgactaacttattactgttcatcaagtacgtactactttacctctaagtnactcacctcggaccgaacggacacgactgggagtaattaaacgacgtcggtgcgtcgaccacncttctgttacccg

SEQ ID NO: 170741 - DNA, 550 bp, Homo sapiens
  misc_feature: GYAE6OF01CZLB6.27.78.H01.1.454.CMB.1.raw
  modified_base (196)..(196): a, c, t, g, unknown or other
  misc_feature (196)..(196): n is a, c, g, or t
  modified_base (479)..(479): a, c, t, g, unknown or other
  misc_feature (479)..(479): n is a, c, g, or t
  modified_base (528)..(528): a, c, t, g, unknown or other
  misc_feature (528)..(528): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatcacctgccgggccagtcagagcgttggtagtagcttacactggtaccagcaagaagccaggtcagtacctccaaagcctcctcatcaagtatcgtctccctagttccttctcgacgggtcccctcggtacgttcgagtggctaggtggatcgcggacaactactttaccaccctcaaccatacaatacgcctaggaaagcctaagaagatacgtctagactaaacttacgttactgtacatacaagtacttacttaacttaacctcaagtnactcaccttcggacaaggaacacgattaggataaacgttaacaagttgngtcagccaactatctgtcttac

SEQ ID NO: 170742 - DNA, 524 bp, Homo sapiens
  misc_feature: GYAE6OF01A19QX.27.78.H01.1.454.CMB.1.raw
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgacggttcagtggcagtggatcgtgggactacactttccacccctcacccatcaaatagcctaggaacgtctagaagatgcctgcctaacttattactgtcatcagtagtactacttacctcaagtnatcaccgttcgaccaaggcacgacgtggagtataaacg

SEQ ID NO: 170743 - DNA, 539 bp, Homo sapiens
  misc_feature: GYAE6OF01A7COQ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgacggttcagtggcagtggatctggacacatttcaccctcaccatacaatagcctaggaagctagaagatgctgactaacttattactgtcatcagtagttacttactttacctactaagtgacttactacccgttcggaccaagggaccacggacgtagggaagtaacgttaaacgagttcgtacggctacgaccaccattctgttcttacc

SEQ ID NO: 170744 - DNA, 590 bp, Homo sapiens
  misc_feature: GYAE6OF01AMGTB.27.78.H01.1.454.CMB.1.raw
  modified_base (391)..(391): a, c, t, g, unknown or other
  misc_feature (391)..(391): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgccttcccacgttccttctccgacggggtccccctggtacggttcaggtggctaggtggatcgngggacactatttccaccctcacccatacaatacgcctaggaacncgtagaacgatgtcctagtacctaacttacttactcgtacatacgaagtaacgttaccttaccgtttacctactaaacgtcgtacttaccgtacccgttaccgggaacccgaaacgggaccaacggtactacgggtaagtaaacgttaaaaccgg

SEQ ID NO: 170745 - DNA, 585 bp, Homo sapiens
  misc_feature: GYAE6OF01AI97F.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtactcgtccttcccacgttcccttctcgacggggtcctccgtcgtaggttcgagtggcaggtggatcgtgggactactactttacccaccctcaactaatacaatacgccgtaggaacgctaggaaagtatgtctacgtactaacttattactgtacatacagtaagttacttaacctttacctactaagtacacttctaccgttacggaccgaagggacctacggtacgtaggtaacgtaacgttaaacgtacgtacggtagacgtacgactaacctcttcgtcgttaccg

SEQ ID NO: 170746 - DNA, 680 bp, Homo sapiens
  misc_feature: GYAE6OF01EJETM.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctggccggcagtcagagcgttggtagtagcttacactggtaccagcagaagccaggtcagtctaccaaagcctcctcatacaagtatcgtccttcccagttcccttctccgtacggggtcccctcggtacggttcaggtcgggcctaggtggatcgtcggggaacctactacctttacccgacccctccaaccctataccaaacgttaccgacccgtagggaactccgtaagaacggtatacggtcgttacggaccttaaactttacgtttaccgttacgttaccaattacgaacggttacgtttaaaccttaaccgttttaaccctaacgttaaacggttacgtaacttacccgtaacccgtttacccgggaacccgtaaaacggggtacccaaccggtaacgttacgggaaacgttaaacgttaaaaacccggg

SEQ ID NO: 170747 - DNA, 563 bp, Homo sapiens
  misc_feature: GYAE6OF01D3YRP.27.78.H01.1.454.CMB.1.raw
  modified_base (464)..(464): a, c, t, g, unknown or other
  misc_feature (464)..(464): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcgacgggtcccctcgaggttcagtggcagtggatcgtgggacacgtatttccaccctcaccatcaagtcgctaggaagctagaaagatgctagactaactttattacctgtacatcctaagtacgttactactttaaccacgtaagttnacttccaccgttacggacccaaagggaccacgtacgtaggtaacgtaacttaaaccggacttcgacggtactacggacctaccgtacttctcggttacc

SEQ ID NO: 170748 - DNA, 510 bp, Homo sapiens
  misc_feature: GYAE6OF01A2TDN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaacgctgaagatgctgctaacttattactgtcatcagagttactactttacctacaagtgtatcctaccgttcggaccaagggacacgactggagtacgttaaacgactgtgctgcacatctgtcttc

SEQ ID NO: 170749 - DNA, 588 bp, Homo sapiens
  misc_feature: GYAE6OF01BWEMC.27.78.H01.1.454.CMB.1.raw
  modified_base (411)..(411): a, c, t, g, unknown or other
  misc_feature (411)..(411): n is a, c, g, or t
  modified_base (574)..(574): a, c, t, g, unknown or other
  misc_feature (574)..(574): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccggccagtcagagcgttggtagtagcttacactggtaccagcagaagccaggtcagtctacaaagctcctcaatcaagtatgccttcccagttccctcgtcgacgggtcccctggacggtttcaggtggcacgtggactacgtgggacactatttccgaccctcaaccatacaatacgcctaggaagctagaaagntgactgtactaactttacgttaactcgtactagttacaagtaccgttaacttaactttacctactaagtacgtaactccgtaaccttccggaccgaagggacctacggaccgtaggtaaactaagttaaaccgaacgttggtaacgtctacggtacaaccgtnttaccgtgttaccc

SEQ ID NO: 170750 - DNA, 686 bp, Homo sapiens
  misc_feature: GYAE6OF01CVTBI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtgaaattgtgctgactcagtctccagactttcagtctgtgactccaaaggagaaaagtcaccatcacctgccgggccagtcagagtcggttggtagtagcttacacgtggtaccagcagaagccaggtcagtctccaaagcctcctcatcaagtatcgccttcccagttccttctccgtacgggtcccctcggtacggttcagtggcctaggtggatcgtgggactactacgtttccaaccctcaaccactacaatacgcctacgggaacgtcgtaggaagtactggtaccttcgtaacctaaactttaacttaccgttagttacaacttacgaacgttaacggttaaaccttttaaccgttttaaaccctacgtaaacggtttacgtaacttacccgtaaccgtttacccggaccggtaaaccgggtaaccgtaccgtaaaccgtcgggtaaacgtaaacgtttaaaaccggaaccgttaggtaccgggtaccttacggtaacccctaaccgtagtttcccttcggttaccttttaaccccg

SEQ ID NO: 170751 - DNA, 719 bp, Homo sapiens
  misc_feature: GYAE6OF01AR1PE.27.78.H01.1.454.CMB.1.raw
tcagagcgtcgtctcacgaccggtgctcgatttagtgtgagtagttggttgggggatcttaaaggaggttctttctctggatggtggcactcgagcgaaaacctggaccaagtcaaggctacggaagactcgttgccatcgacaactcgattgggttcctgctgcctctggttccagcctcgacgggtcgaagttcgtggctcgacgtcagtcctccacgacctttcacgtcctgtcactaccgaaacggacgaaacgtcaccgtatcctacgttgaccggtcctagtccacgtagtcgttacggaagtaacgtacccttaacgacgtacggtaccccaagtccaagaacgacctaggtcacgttctaccaaagtcctcctctactacgtaactagtcgtacctttccgacgttccttcctacgacggttcccctggtacgtcgacggtccgtcaggtcgactccgtaggactactacttccgacctcaaccgtagacgaactacgccttaggaacgtcgtagaacgtcgtacgtactacgtaccgtaacgtttacgttacgtacgtacctactaccgtaaggttaccggtttacgtaacccgtttaccgtaaccgaaacggtttcgtaaccgttacccgtacccggtttacgggaaccccgaaacgggtacccctaacggtaccgttccgggaaaccgttaaacggttaaaaccccgg

SEQ ID NO: 170752 - DNA, 549 bp, Homo sapiens
  misc_feature: GYAE6OF01BILA4.27.78.H01.1.454.CMB.1.raw
tcagagcgtcgtctcacgaccggtgctcgatttagtgtgagtagtttgggtttggggatgagcaaaactgacaagtcaaggcaggaagatgttagccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttctcagggtcccctgagttcagtgcagtggatctggacacatttcaccctcaccatcaatagcctggaagctagaagatgctgactaacttattactgtcatcagtagtaccttacttacctactaagtagtactactaccgttaccgtaccgaaccggaacgacgaaccgtacggtaacggaacgttaaacgtaaaccgtagttacggacgtacgtaccgaccactcgttcgtcgttacc

SEQ ID NO: 170753 - DNA, 604 bp, Homo sapiens
  misc_feature: GYAE6OF01B7DPU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagaaattgtgctgactcagtctccagtactttcagtctgtgaactacaaaggagaaacgtcaaccatcacctcggccgggcagtcaggagtcggttaggtagtagcttaacacgtacggaaccagacaagaagccaggtcagtctaccaaagcctacctacaactacaagtactcgccttacccacgttccttctaccggtacgggtcccctaggtaggttacaggtggcaaggtgactcgtaggacacgtactcaccctacactatacaagtacgccgtaggaatctagaacgatgtactagactaaacttatactgtacatacgagtaactaactacttacacaagtacgactacaccgttacggacgtaaaggaccgacgaacgtaggtaaacgtaaacttaaaacggaactggttacggacgtacgtaccaacctatcgttccgttcttaccg

SEQ ID NO: 170754 - DNA, 599 bp, Homo sapiens
  misc_feature: GYAE6OF01BXOHM.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatccaagtatgcttcccagtccttctcgacgggtcccctgagttcagtgcagtgatcgtgggacactattcacctcaccatcaatacgcctaggaagcgtagaagtatgtctacgacgtaactttattacgtgtacattacaagtaacgttaacttaaccgttttaacctacgtaagttacgtacttacgtacccgttaccggaccggaaacggtaccgaccggtaacgtacgggtaacggtaacgttaaaaccggtaaacgttcggtaacggtccgttacgtacaacccgtacttccgtcgtttacccg

SEQ ID NO: 170755 - DNA, 539 bp, Homo sapiens
  misc_feature: GYAE6OF01BX8DH.27.78.H01.1.454.CMB.1.raw
  modified_base (426)..(426): a, c, t, g, unknown or other
  misc_feature (426)..(426): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcagtggcaggtggatcgtgggacacgactttccacccctcacccatcaatacgcctggaanctagaagatgctgctaacttattactgtcatcagtagtacttactttacctctaagtcgattccaccgtttaccggaccaaagggtccaacggactggaagtaattaaaccgg

SEQ ID NO: 170756 - DNA, 673 bp, Homo sapiens
  misc_feature: GYAE6OF01A0KHB.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaagcagaagatgttgccatcacaactactattgggttttcgttgctgctcttgggttccgtacgccgtccctagggggtaggtaaattagttggctgactcagtctccagactttctagtctgtgactaccaaaggaagaaagtcaccatcacctcggccgggccagtcagagtcggttggtaagtagtcttactacgtggtaccagcagaagccgaggtcactctaccaaacgctcctacatacaagtatcgtcccttccagttccttctcgaccggggtccctcgaggtttcagtcggctacggtggattcgtacgggactacctactttcaccctacacctactacaactagcccgtaggaactcgtaggaacgtagtcgtacgtcgtaacttaaactttaactttaccgttcgttaccgtaattaccgtaagtaaccgtttaaccctttaacttttaaccctacggtaaacgtttagacctttaccgtaccccgtttaccgggaacccgtaaacgggtaacctacgtaaaccggtggtaaacgttaaacgttaaaaccg

SEQ ID NO: 170757 - DNA, 701 bp, Homo sapiens
  misc_feature: GYAE6OF01DEUS3.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtnaaattgtgctgactcagtctccagactttcagtctgtgactcaaaggagaagtcacatcacctgccggcagtcagagcgttggtagtagcttacacgtggtaccagacagaacgccaggtcagtctaccaaagctcctacactcaagtactcgtaccttcccacgttccttacgtccggtaccggggttcccctacggtacggttcgacggtcggtacgtaggttacggtacgttcggtacggggaactaccgtaacttttaccccaccccttaccgtaacccctaattaccgtaaacgttaccggacccgttaagggaacgtaccgtaggaaacgtgtacgtaccttaacggtaccttaaactttatttaccgttagtaacctacgttacgaacgttacgtttaaaccttaccgtttaacccgtagtaaacggttacgtaacttacccgttaacccggtcggtaacccgaaacgggtaccgtaacggtaacgtacgggtaaagtaaaccggttaaaacggg

SEQ ID NO: 170758 - DNA, 702 bp, Homo sapiens
  misc_feature: GYAE6OF01EA02V.27.78.H01.1.454.CMB.1.raw
  modified_base (399)..(399): a, c, t, g, unknown or other
  misc_feature (399)..(399): n is a, c, g, or t
  modified_base (517)..(517): a, c, t, g, unknown or other
  misc_feature (517)..(517): n is a, c, g, or t
tcagagcgtcgtctcacgaccggtgctcgatttagtgtgagtagtttgggtttgggggtaggtctttaaaagaggttctttctctgggagtgtgacatgagcaaaaactagacaaagtcaacggcagggtaactacttcgttgccagtcgacgaaccttccaagttgggttttcgtcgcttcgtctcttggggttcccaggccgtccggagggggttcggaaacttggtgtcgtgaacttcggacgttctcccagtacttttcagttctgtcgacgtacctaaaggtagaaaacgtcgaaccatccgaccttcgaccggggtccgagtcgagacgccgttggtaccgtaggacgttacactgtaccagtcagaagccaggtcagtctcgaagcctcctnatcaagtctcgtctccgagtccttctcacgggtccctcgtacggttcagtgctagtaggacttcgttcgggacactctttcacccgttcaccactaccaagtacgacgtacgggaacnccgttaggaagtattcgtcgtacggacttaactttactttacctcgttactagttacgtacgggttaacgttaaccttaaccgtttacccgtaacttaacggttacgtacttacccgttccgttaccgggaccgtaaacgggtacctaacggtaccggtacgggtaagggtacttaaaacccggg

SEQ ID NO: 170759 - DNA, 717 bp, Homo sapiens
  misc_feature: GYAE6OF01EB99E.27.78.H01.1.454.CMB.1.raw
  modified_base (544)..(544): a, c, t, g, unknown or other
  misc_feature (544)..(544): n is a, c, g, or t
tcagagcgtcgtctcacgaccggtgctcgatttagtgtgagtagtttgggtttggggtagtcttaaaagaaggttcttttcttctgggatgtggcatgagcaaaactagacaagtcaaggcaggaagatgttgccatcacaactcattgggtttctgctgctctgggttccacgcctccagggtgaaattgtgctgactcagtctccagactttcagtctgtgactccgaaagagaaagtcaccatcacctgccgggcacgtcacgagcgttggtagtagtcttactacgtggtaccacgacacgaaacgccgacggtactacgtcctaccaaacgcctccctcaatacctaaagttactcgtcctttaccccgtacgttcctttctaccggtaccggggttcccccgttacggacggtttcgtaaggttcgggaccgtaaggtgggtacgttcggttaggacgtaacccttacgttttaccaacccccttaccaaccctaactaccaaagtacgcccgttagggaacggtccttagggaaaancgtttacgcctacggaaccttaaacttttacgttacgttacgttaccagttacaagggttaactaacttttaaccctttacctaacgaaaggttctaactccgttaacccgttccggaaacccggaacgggtaaccacggtaaccgtagggtaacgtaaactttaaaaccggg

SEQ ID NO: 170760 - DNA, 587 bp, Homo sapiens
  misc_feature: GYAE6OF01EJ0X9.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagcctcctcatcaagtatcgccttcccagttccttctcgtacggggtcccctcggtacggttcagtggcaggtggatcgtgggacacgtactttccaccctcaccatcaatacgcctaggaatcgtagaagatgctgactaacttattactntctatctaagtacgttaccttactttacctactaagtctacttacctacccgttaccggaccgaaacgggaccgaaccggtacgtaggtaacgtaaacgttaaaacggaaccgttggtacggtctacgtaccaacctacttcttcgttccttaccc

SEQ ID NO: 170761 - DNA, 829 bp, Homo sapiens
  misc_feature: GYAE6OF01DZETQ.27.78.H01.1.454.CMB.1.raw
  modified_base (187)..(187): a, c, t, g, unknown or other
  misc_feature (187)..(187): n is a, c, g, or t
tcagagcgtcgtctcacgaccggtgctcgatttagtgtgagtagtttgggtttggggatcttaaaagagggttctttcgtctgggatcgtggtcagtgagcaaaactgacaagtcaaggcgacggaagatgttgccagtcacaactcattgggtttctcgctgctctgggtccagcctccgagggtnaattcgtgctgactctagtctccagtactttcagttcgtgtacgactaccgaaaggtagaaacgtcaccatccgacgtcggcggcagtcagagcgttaggtacgtagtcgttaactacgtacggtaaccacgacgaacgaacgccgaacgggtcctacgtcctaccaaacgtcctacctactaacttactaaggttactacgtccttaccccgtagttacctttccgtacgtaccggggtcccctacggtacggttacgacggttcgggacgtacggtacggtacttaccggtacgggaacctacgttaacttttcccgaaccctttacaacccgttaataccgtaagttaccggaccgttaagggtaaacgtcgttaacggtaaagacgtttacggtaccttaggtaaaccgtttaaaaccgttttcggtttaaccttcggttaaccctaacgtttacccggtaaacgggttaacccggtttacctttaaacccgtttaacccgttaacggtaaaggttacccggttaacgttaccctaaaccccgggttaccggggtaaaccccggttaaacggggtaaccccttaacccggggttaacccttaaacggggtaaacgttaaacccgtttaaaacccgggg

SEQ ID NO: 170762 - DNA, 534 bp, Homo sapiens
  misc_feature: GYAE6OF01BMG1P.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacactatttccaccctcaccatcaatagccgtggaagctagaagatgctgactaacttatactgtcatcagtaataccttactttacctactaagttgactctacccgttcggaccgaagggaccacgacgtggaagtaacttaaacgaacgtcgtaggctagacctaccattcttcgtcttacc

SEQ ID NO: 170763 - DNA, 548 bp, Homo sapiens
  misc_feature: GYAE6OF01C5XHW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcccagtcagagcgttggtagtagcttacactggtaccagcagaagccaggtcagtctccaaagctcctcatcaagtatgcttcccagtccttctcagggtcccctcgacggttcagtggcagtggatctgggacactatttccacccctcaccatacaatacgcctaggaagcctagaagatgctgacaactttattactgtcatcagtagtacttactttacctacaagtgtactcaccttcggccaagggaccaacggactagggaagtaacgttaaaccgaacgttggtacggtacctggtaccaacctattcctgttctttacccg

SEQ ID NO: 170764 - DNA, 530 bp, Homo sapiens
  misc_feature: GYAE6OF01ESEPK.27.78.H01.1.454.CMB.1.raw
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacactttccaccctcacccatacaatagccctagggaacgctagaagntgctgacaacttatactgtcatcagagtactacttacctnaagtnactctaccttcggaccgaagggaccacggactaggactaataaacgtaacg

SEQ ID NO: 170765 - DNA, 507 bp, Homo sapiens
  misc_feature: GYAE6OF01BC7YT.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgagttcagtggcagtgatctggacacatttccaccctcacctatcaatacgcctggaagctagaagatgctgactaacttattactgtacatcaagtagtacttactttacctacaagtgtactcaccgttcggaccaagggacacgactaggagtaataaacgatgtgctgcacatctgtctac

SEQ ID NO: 170766 - DNA, 553 bp, Homo sapiens
  misc_feature: GYAE6OF01DIRZZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcaagaagccaggtcagtctccaaagctcctcatcaagtatcgcttcccagtccttctcacgggtcccctgacggttcagtggcagtggatctgggacactatttccaccctcaccatacaatacgcctaggaagctagaagatgctagactaacttattactgtacatcaagtacgttaacctactttaacctcaagtgatccaccgttcggaccaagggaccacgaccgtaggaacgtaacttaaaacggacgttggtcggtcctaggacctaacccattcctgttccttaccg

SEQ ID NO: 170767 - DNA, 550 bp, Homo sapiens
  misc_feature: GYAE6OF01CF8HN.27.78.H01.1.454.CMB.1.raw
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgacggttcaggtggcagtggatcgtgggacacattcaccctcaccatcaatagcctggaagctagaagntgctgactaacttatactgtcatcagacttacttaactttacctactaagtgtacttcctaaccgtttccggaccgtaaagggaccacggacgtagggacgtaacgttaaacgaacgttggtacggtctacgtaccaccattcttcgttcttaccg

SEQ ID NO: 170768 - DNA, 598 bp, Homo sapiens
  misc_feature: GYAE6OF01BFTSY.27.78.H01.1.454.CMB.1.raw
  modified_base (327)..(327): a, c, t, g, unknown or other
  misc_feature (327)..(327): n is a, c, g, or t
  modified_base (533)..(533): a, c, t, g, unknown or other
  misc_feature (533)..(533): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtcctccagactttcagtctgtgactccgaaaggagaaacgtcaccatcacctgccggccagtcagagtcgttggtagtagcttacacgtggtaccagacagaagccaggtcagtcctaccaagcctacctnactacaagtatcgtccttacccatcccttcgtcgacgggtccctggacgttcagtgctagtgactcgtaggactacgtactttccacccttacaccctagtaccaaagtcgaccgtaggaagcgtagaagtacgtgacctagtacctaactttatacccgtagtactagtacgtagtaacgttaccttaccttacctagtaacgtntaaccgttcgtacccgtacggaaccgtaacggaccaaccgtacgaggtacgtaaattaaacccgg

SEQ ID NO: 170769 - DNA, 524 bp, Homo sapiens
  misc_feature: GYAE6OF01AVU7U.27.78.H01.1.454.CMB.1.raw
  modified_base (499)..(499): a, c, t, g, unknown or other
  misc_feature (499)..(499): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctcaaagctcctcatcaagtatgcttcccagtccttctcacggttcccctcgtaggttcagtggcagtgatcgtgggacactatttcaccctcaccatcaatacgctggaacgctgaagatgactgacctaacttattactgtcatcagtacgtactactttacctcaagtgtactctacctacggaccgtagggacacgtactaggtagtaattaacggacttgnggtactcggaccacactctgttacc

SEQ ID NO: 170770 - DNA, 496 bp, Homo sapiens
  misc_feature: GYAE6OF01DR5X4.27.78.H01.1.454.CMB.1.raw
  modified_base (344)..(344): a, c, t, g, unknown or other
  misc_feature (344)..(344): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcagaagccaggtcagtctcaaagctcctcatcaagtatgcttcccagtccttctcacgggtccctcgagttcagtggcagtgatcnggacacatttcaccctcaccatcaatacgcctggaagctgaagatgctgacaacttatactgtcatcagactatactttactcaagtgtatcaccttcggccaaggacacgactaggagtattaaacgactgaggctcgcacatctgtctac

SEQ ID NO: 170771 - DNA, 556 bp, Homo sapiens
  misc_feature: GYAE6OF01B4NAS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctccacggggtcccctcgaggttcaggtggcaggtggatcgtgggacacgactttccaccctcaccatcaatagcctggaacgctgaagatgctgacctaactttattactgtacatacaagtactacttactttacctactaagtctaattccaaccgtttcggacccgtaagggaccacggacgtagggaagtaactaaacgtaacgtcggtacggtactcgacaccgattcgtgttccttacc

SEQ ID NO: 170772 - DNA, 530 bp, Homo sapiens
  misc_feature: GYAE6OF01BX7GQ.27.78.H01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacgggtcccctgagttcagtggcagtgatcgtggacactatttccaccctcaccatacaaatacgcctaggaacgctagaagatgctagactaacttattactgtacatcagtacgtacttacttacctanaagtgactcacttcggacaaggaccacgacgtaggaacgtaagttaaacgagtgtggtactacgacaaccgtatcctgtcctaccg

SEQ ID NO: 170773 - DNA, 520 bp, Homo sapiens
  misc_feature: GYAE6OF01EV2G0.27.78.H01.1.454.CMB.1.raw
  modified_base (447)..(447): a, c, t, g, unknown or other
  misc_feature (447)..(447): n is a, c, g, or t
  modified_base (502)..(502): a, c, t, g, unknown or other
  misc_feature (502)..(502): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgaggttcagtggcagtggatcgtgggacactactttccaccctcaccatcaaatacgcctggaacgctagaagatgctagctaacttattactgtacatacagtacgtacttactttacctanaagtgactcaccttcggaccaagggacacgacgtggaagtacttaaacgacgtgngctgacactatctgtctc

SEQ ID NO: 170774 - DNA, 780 bp, Homo sapiens
  misc_feature: GYAE6OF01BM5PP.27.78.H01.1.454.CMB.1.raw
tcagagcgtcgtctcacgaccggtgctcgattttagtgtgagtagtttgggtttgggggattcgtttaaaaggaggtttctttcgtcgtgggatggtggcagtagagcaaaactgacaagtcaacggcaggaagacttcgttcgccattcacaactcagtttgggtttctgctcgcttcgttgggttccagccctccgaggggtagtaaacttcggtgcttgactcacgtctaccaagtacctttcgagttctgtgactaccgaaaggagaaagtccacctataccaaccgtggacccggtctagtcgagagtcgttaggtagtagtctacacgtcggtacagcgagacgccgaggtcacgtcctacgaacgcctcctacgacgtactaacgtgtacgtccttccctagttccccttcgtacccgtaccggggttcccctacggtacggtttaccgaggttcgggaccgtaggttacggtactccggtagggtaaccctacgttaccgtttccccgaacccgttaccgtaaacccgtagttaaccgtaaacgtaccgtaccgttaagggtaacgttccgttaagggaacctacgtacgtacttacgtaacttaacgtttacttacgttcgtacgtaggttacgacggtaacgtttaccgttaaccgttttaaccgtacgtaacggttcgttaaccgtaccctacccgggttacccggaaccggtaaaccgggtaccctaacccgggtacgtaacggtaacgttaaaccgtttaaacccgg

SEQ ID NO: 170775 - DNA, 502 bp, Homo sapiens
  misc_feature: GYAE6OF01DKYYZ.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaaagctcctcatcaagtatgcttcccagtccttctcagggtcccctcgaggttcagtggcagtggatctgggacacatttcaccctcaacatcaaatagcctggaagctgaagatgctgcaacttattactgtcatcagagtactactttacctnaagtgatcacttcggccaaggacacgactaggagaattaaacgaactgtgctgcaaccatctgtcttac

SEQ ID NO: 170776 - DNA, 517 bp, Homo sapiens
  misc_feature: GYAE6OF01E2MXZ.27.78.H01.1.454.CMB.1.raw
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatcgtgggacactatttccaccctcaccatcaatagcctggaacgctagaagatgctgactaacttattactgtacatcagtacgtactactttacnctaagtnactcaccttcggaccaagggaccacgactaggaagacgttaaacgaactgtaggctgacacatctgtcttacc

SEQ ID NO: 170777 - DNA, 521 bp, Homo sapiens
  misc_feature: GYAE6OF01DFUHD.27.78.H01.1.454.CMB.1.raw
  modified_base (421)..(421): a, c, t, g, unknown or other
  misc_feature (421)..(421): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatctgggacacgatttcaccctcaccatcaatagcctggaagctagaacgatgctgacaacttattactgtcatcanagtactacttacctcaagtgatcaccgttcggccaagggacacgacgtcggaagaattaaaccgactacggtgaccgttagaccacctaactctgttacc

SEQ ID NO: 170778 - DNA, 533 bp, Homo sapiens
  misc_feature: GYAE6OF01CG6L2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctccgtacggggtccccctcggacggttcaggtggcaggtggatcgtgggacacgtactttcaccctcaccatccaatcgcctaggaagctagaagatgctcgactaacttattactgtcatcagtacgttacctactttacctactaagtctatctaccttcggaccaacggacacgactaggacgtaattaacgactgtcgctgacacatcttgtcttacc

SEQ ID NO: 170779 - DNA, 576 bp, Homo sapiens
  misc_feature: GYAE6OF01AIB93.27.78.H01.1.454.CMB.1.raw
  modified_base (466)..(466): a, c, t, g, unknown or other
  misc_feature (466)..(466): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgccttcccagttcccttctcgacggggtcccctcggaggttcaggtggcaggtggatcgtgggacactatttccaccctcaccataccaatacgccgtaggaacgctagaacgtatgctgtactaactttattactgtctatacagtactacttaactttacctanaagtcgtactacctaccgttacggaccgaagggaccacggtacgtagggaacgtaacgttaaacggacttggtacggtacgtacgaccaaccgtacttcgttgttacccg

SEQ ID NO: 170780 - DNA, 526 bp, Homo sapiens
  misc_feature: GYAE6OF01BIVEJ.27.78.H01.1.454.CMB.1.raw
  modified_base (195)..(195): a, c, t, g, unknown or other
  misc_feature (195)..(195): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggagtagcttacactggtaccagcagaagccaggtcagtctccaaagcctcctcatcaagtatcgccttcccagtccttctcgacggggtcccctcgaggtttcagtggcaggtggactctgggacactatttccaccctcaccatcaatacgcctggaagctgaagatgctgactaactttatactgtcatcagtagttaccttactttacctctaagtgacttcaccttcggaccgaaggacacgactggacgtaacttaaacgacttgnggctagcactatctgtcttacc

SEQ ID NO: 170781 - DNA, 702 bp, Homo sapiens
  misc_feature: GYAE6OF01BVMGZ.27.78.H01.1.454.CMB.1.raw
  modified_base (318)..(318): a, c, t, g, unknown or other
  misc_feature (318)..(318): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccagggtgaaattgtgctgactcagtctccagactttcagtctgtgactccaaaggagaaagtcaccatcacctgccgggccagtcagagtcgttggtagtagcttacactcggtaccagcagaagccaggtcagtctaccaaagctcctcatacaagtatcgtccttccctagttccttcncgtacgggtcccctcggtacggttcgaggtggacgtagtggtactcgtacggactactactttccaacccctcaacctacgtacctaaacgtacggtacccgttaagggaacgtaccgttaggaaacgtacgttcgacgttacgtaaccttaaaccgttttaacttaaccgtttacgttacctaacgttaccgtaaacgttaaccgtttaacctttaaacccgttttaccgtaacgttaacggttacgtaaccttacccgtaacccgttacccgggaaccgtaaacggggtaccaccggtaacgtagggtaacgtaaacgttaaacggacgttagggtaccggtactacggtaccaccgttatccgtttcgtccgtttaacccg

SEQ ID NO: 170782 - DNA, 583 bp, Homo sapiens
  misc_feature: GYAE6OF01CY7FJ.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactaccaaaggagaaagtcaccatcacctgccggccagtcagagcgttggtagtagcttacactggtaccagcagaagccaggtcagtctccaaagctcctcatcaagtatgccttccagtccttctcgacggggtcccctggacggttcagtggcagtgtatcgtgggacactacttccaccctccaccactacaatacgaccgtaggaacgcgtagaagtactgctagacgtaacttattactgtcaatcgagtacgttacttacctttacctacgtaacgtcgtaattccgtacccgttaccgggaacccgtaaacgggacctaaccggacggttacggtaagtaaacgttaaaaacccggg

SEQ ID NO: 170783 - DNA, 514 bp, Homo sapiens
  misc_feature: GYAE6OF01C9VRB.27.78.H01.1.454.CMB.1.raw
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaaagctcctcatcaagtatgcttcccagtccttctcagggtcccctgaggttcagtggcagtggatcgtgggacactacttccaccctcaccatacaaatacgcctaggaagctaggaagatgctgactaacttattactgtcatcagatacttactttacctcaagtgtatcctacgttccggacaacgggacacgacgtggagaacttaaacgatgtgctgcacntcntctac

SEQ ID NO: 170784 - DNA, 636 bp, Homo sapiens
  misc_feature: GYAE6OF01D9EB5.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccgggccagtcagagtcgttggtagtgcttacacgtggaccagcagaacgccgaggtcagtctaccaaagcctcctcatcaagtactcgtcccttcccgtagttccctttccgtaccggtaccgggttcccctacgggtacggttcgacggtcggcgtaggtcggtactcggtaggacctacgtactttccaaccctcaactactacaagtacgacgtaggaacgtcgtagaagtatcgactagtaactaactttacttacttagtctaagtctaagtacgttaccttaactttccgtaagtaacgtcgtacttcccgtaaccgttccggaccgtaaacgggacctaacggtacgtaaggtacgtaaacgtaacggtacgtcggttacgctacggacctacctagttcgttgtcttacccg

SEQ ID NO: 170785 - DNA, 531 bp, Homo sapiens
  misc_feature: GYAE6OF01A15VW.27.78.H01.1.454.CMB.1.raw
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttccaccctcaccatcaatacgcctggaagctagaagatgctgctaacttattactgtcatcagatacttactttacctactaagtntatcctaccgttacggaccgaagggaccacgacgtaggaacgtaacttaaacgaactgtcggctacgaccacctatctgttccttacc

SEQ ID NO: 170786 - DNA, 600 bp, Homo sapiens
  misc_feature: GYAE6OF01AQKKT.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcaggtggcagtggatcgtagggacactatttccaccctcaccatcaatacgcctaggaagctagaagtatgctagactaacttacttactgtcatacagtagttacttaacctttacctacgtaagtcgtacttaccgtacccgttacggacccgtaaacggggtaccaaccgggtaaccgtagggtaacggtaaagttaaaacccggtaacgttacgggtacgggtaccttacggaccctaacctacgttccgttcgtttacccg

SEQ ID NO: 170787 - DNA, 596 bp, Homo sapiens
  misc_feature: GYAE6OF01CWY4H.27.78.H01.1.454.CMB.1.raw
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccgggccagtcagagcgttggtagtagcttanactggtaccagcagaagccaggtcagtctccaaagctcctcatcaagtatgcttcccagtccttctcgagggtcccctgaggttcagtggcagtgatcgtgggacactatttccaccctcacatcaatagcctaggaancgtagagatgctagactaactttattactcgtacattcaagtacgttaccttacttttaaccctcgtaaagtcgtattacccgtaccgtttacgggacccgaaacggggtaccctaaacggacgttacgggaaagtaaacgtttaaaaccggaactttacggtacgggtactacggcctaaacccggtatttccgtgtttccctttaaccg

SEQ ID NO: 170788 - DNA, 551 bp, Homo sapiens
  misc_feature: GYAE6OF01EZCUV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagcctcctcatcaagtatgcttcccagttccttctcacgggtcccctcgtacggttcaggtcggcaggtggatcgtgggacacgtactttccaccctcaccatcaactacgcctaggaacgctcgaagatagctgactaacttattactgtacatcaagtacgttactactttacctactaagttgacttacaccgttcggaccaaagggaccacggtacgtaggaagtaacgttaaacgaactggtcgacgtcgacacctatctgtccttacc

SEQ ID NO: 170789 - DNA, 512 bp, Homo sapiens
  misc_feature: GYAE6OF01DJAEX.27.78.H01.1.454.CMB.1.raw
  modified_base (506)..(506): a, c, t, g, unknown or other
  misc_feature (506)..(506): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgacggttcagtggcagtggatcgtgggacacatttccaccctcaccatcaatacgcctggaagctgaacgatgctagctaacttattactgtacatcaagtagtactaactttacctcaagtgactcaccttcggaccaacggcacgactaggaagtattaaacgactgtgctgcaccntctgtc

SEQ ID NO: 170790 - DNA, 589 bp, Homo sapiens
  misc_feature: GYAE6OF01AIUJ2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgccttcccagtccttctcacggggtcccctcgaggttcagtggcagtggatcgtgggacactactttcaccctcaccatcaatacgcctggaagctagaagatcgactgacctaattatactgtacatcaagtacttaccttaacttttacctactaaagtcgtaacttccgtaacccgttaccggaccgtaaacgggaccgtaccggaacgttaggggaaacgtaacgtttaaaaccgaacgttcggtacgggtaccttacggacctaccctattaccgttgttcctttacccg

SEQ ID NO: 170791 - DNA, 594 bp, Homo sapiens
  misc_feature: GYAE6OF01AFSV4.27.78.H01.1.454.CMB.1.raw
  modified_base (148)..(148): a, c, t, g, unknown or other
  misc_feature (148)..(148): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccggccagtcagagcgttaggagtagcttacactggtaccagcagaagccaggtcagtctaccaaagctcctcatcaagtatcgcttcccagttcccttctcgacggggtcccctcggacggtttcacggtggcctaggtggattcgtagggacactatttccaccctcgaccatacgaattacgcccgttaggaacgcgttagaacgtagtcgctacgtacctaaactttagtttacctgtacattcgagtacgttactacctttacactaagtntaactctacccgttcggacccgtaagggcctacgtacgtggtaacgtaacgttaaacggaacttcggaggtacctcggacctacctacttccgttgttacccg

SEQ ID NO: 170792 - DNA, 520 bp, Homo sapiens
  misc_feature: GYAE6OF01C00X2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacgtatttcaccctcaccatcaatagcctaggaacgctagaagatgctgactaactttatactgtcatcagatacttactttacctcaagtgtactctaccgttcggaccgaagggacacgactggagtattaaacgactgtacggctcgcaccatcctgtcttaccg

SEQ ID NO: 170793 - DNA, 678 bp, Homo sapiens
  misc_feature: GYAE6OF01DAL95.27.78.H01.1.454.CMB.1.raw
  modified_base (432)..(432): a, c, t, g, unknown or other
  misc_feature (432)..(432): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagtcgttggtagtagcttacactggtaccagcagaagccaggtcagtctaccaaagcctcctcatcaagttatcgtccttcccacgttcccttactcgacggggttcccctggtacggttcaggtggctaggtggatcgtgggtaccactactttccaccctcaaccgtataccaagtacgccgtaggtaacgcctaggaaagtntcggacttcggtaaccttaacgtttactttacgtcgtactattaccgtaacgtaacgtttaacctttaacctttaaccgttaccgtaaacgtttcgtaaccgttacccgtaacccggttacccgggaacccgtaaaacggggaacctaccgggtaaccgttaacgggaaacgttaacgttaaaaccggtacgttacgggttcggacccttacggaccctaacccgtacttccgttcgtttaccccg

SEQ ID NO: 170794 - DNA, 557 bp, Homo sapiens
  misc_feature: GYAE6OF01CPZ1O.27.78.H01.1.454.CMB.1.raw
  modified_base (321)..(321): a, c, t, g, unknown or other
  misc_feature (321)..(321): n is a, c, g, or t
  modified_base (509)..(509): a, c, t, g, unknown or other
  misc_feature (509)..(509): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagactttcagtctgtgactacaaaggagaaagtcaccatcacctgccggccagtcagagtcgttggtagtagcttacactggtaccagcaagaacgcaggtcagtctaccaaagctccnatcaagtactgcttcccagtccttctcgacgggttccctagacggttcaggtcgcgtaggtgactcgtgggacactacttccacctcaaccatacaagtacgccgtaggaacgtcgtagaacgacgtgacctagtactaaatttacttactgtactatacagtaacgtaacttacttaccgataagtntactacaccttacggacaacgggactacgagtagaagtaacgtaaacg

SEQ ID NO: 170795 - DNA, 663 bp, Homo sapiens
  misc_feature: GYAE6OF01BSITO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcaggtggcagtggatcgtgggacacgatttccaccctcaccataccaaatacgcctaggaacgcgttagaagtagtggactggtacctaaactttatttaacctgttacctaacttactaaggtaacgttaacctttaaccttttaaccctactaaacggttacgtaacttacccgtaacccgtttccgggaacccgaaacggggtaaccctaaccgggtaaccgttaaggggtaaacgtaaacggtttaaaaaccggtaaccgttacgggtacgggtaccgttacggtaccctaaccccgtaatttacccgttcggtttccctttaaccccg

SEQ ID NO: 170796 - DNA, 557 bp, Homo sapiens
  misc_feature: GYAE6OF01C9WBP.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgccttcccacgtccttctcgacgggtcccctcgacggttcaggtgcgagtggatcgtgggacactactttccaccctcacctatacaatacgacctaggacgctagaagtactgctagactaacttacttactntacatcgagtacgtacttacctttaccactaagtcgtactcgtaccgttcggacctaacgggacacggtactaggactaacttaaacggactggtagcgtacgacctacctactcttcgttacc

SEQ ID NO: 170797 - DNA, 538 bp, Homo sapiens
  misc_feature: GYAE6OF01CLOSO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtgatctgggacacatttcaccctcaccatcaaatacgcctgggaagctagaacgataggctgaccaactttattaactgtcatcaagtagtaccttaactttacctactaagtgaatccaccgtttcggacccaaaggggaccaacggacctagggaagaacttaaaacggaactgtaggctggcaccatctgtcttacg

SEQ ID NO: 170798 - DNA, 612 bp, Homo sapiens
  misc_feature: GYAE6OF01BV8BF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccgggcagtcagagcgttggtagtagcttacactggtaccagacagaacgccaggtcagtctaccaaagcctcctacatacaagttatcgtccttcccagttccttctccgacggggtcccctggaggttcaggtggcaggtgatcgtggacactattccaaccctacaccatacaatacgaccgtaggaagcgtagaagtatcgtactagactaaacttatttaacctgtactaatcgaagttaacgttaaccttaacctttacctaacgtaacgtacgtaactccgtaaccgttacggacccgaacgggaacaaccggtacgtaacggaaggtaaacgttaaacggtaacgttggtacggtactacgtaccaacctattctacgttcttaacccg

SEQ ID NO: 170799 - DNA, 571 bp, Homo sapiens
  misc_feature: GYAE6OF01BW2O0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacactatttccaccctcacctatacaaatacgcctaggaagctagaagtatgcgtgactaaactttacttactgtactatcaagtagttaccttactttacctactaagtactactaccgtaccgttcggaccgaaagggacctaacgtacgtagggaacgtaacgttaaaacggacgttggtacggtcctacggaccaactaattccttgtccttaccg

SEQ ID NO: 170800 - DNA, 747 bp, Homo sapiens
  misc_feature: GYAE6OF01C0GPM.27.78.H01.1.454.CMB.1.raw
tcagagcgtcgtctcacgaccggtgctcgatttagtgtgagtagtttgggtttgggggtagtgagcaaaactgacaagtcaaggcaggaagatgttgccatcacaactcattgggtttctgctgctcgtgggttccagcctccgaggggtgaattgtgctgtactcagtctcctagtactttcagtctgtgactaccgaaaggagtaaagtcaccagtccgaccgtcggcccgggccagtcgaggacgtcggttaggtagtacgtcttacgacgtacggtaccagacaaggaacgccgtaaggtcgacgtcctaccgaaagtccctccgtactacgtaccgaagttactccgtaccttcccgacggttcccttcggtccggtaccggggtccccctacggtacggttcgaaggtgggtacgtaggtacggaacgttacgtacgggtaacctacgttaccttacccgtacccctccgtaacccctaattacccgtaaacgtaccgtaccgtacgggaaccgtacgtaaggaaacgtaccgtagtacctaggtaaccttaactttagttactaacgtactacgtaccgtaacgttacgttaccgttaacctttaccgaacgtaacgttaccgtaacttacccgtaccgttaccggacgtaaacggcctaacggacgttaggaaacgttaaacgtaacggaacgttacggcgtaccgtgtaaccctacgtattccgtcttccgttaaccg

SEQ ID NO: 170801 - DNA, 499 bp, Homo sapiens
  misc_feature: GYAE6OF01A4KFC.27.78.H01.1.454.CMB.1.raw
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
  modified_base (493)..(493): a, c, t, g, unknown or other
  misc_feature (493)..(493): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttccaccctcaccatcaatacgcctggaagctagaagatgctgctaacttattactgtcatcagtagtactactttaccnaagtgatcaccttcggccaaggcacganggatattaaacgactgtggctgcaccntctgtc

SEQ ID NO: 170802 - DNA, 579 bp, Homo sapiens
  misc_feature: GYAE6OF01AJGE9.27.78.H01.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (459)..(459): a, c, t, g, unknown or other
  misc_feature (459)..(459): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgactaccgaaagganaaagtcaccatccacctggccggccagtcagagcgttggtagtagcttacactggtaccagcagaagccaggtcagtccnccaaagcctcctnatccaagttctcgccttcccagttcccttctccgaccggggttccccctggtacggttcaggtcggctaggtggattcgtaggggacctactactttccacccctcaaccctatacaagtacgccgtaggaacncgtagaagctgctgactaacttattactgtacatcgagtacgttacctactttaccacgtaagtctactccgtaccgtaccggaccgaacggactacgagtacggaagtaacgtaaacgg

SEQ ID NO: 170803 - DNA, 552 bp, Homo sapiens
  misc_feature: GYAE6OF01E1N0D.27.78.H01.1.454.CMB.1.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (482)..(482): a, c, t, g, unknown or other
  misc_feature (482)..(482): n is a, c, g, or t
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagctcctcatacaagttatcgtccttcccagttccctttctccgtacggggttcccctacggtaggttcaggtcggcgaggtggatcgtgggacctactatttcaccctcaccatacaatcgctaggaacgctagaagtntgctagaccttaactttnttactgtactatcaagtcttaacttacctttacctacaagtnacttcaccgtcggaccgaaggacacgaacgtggaactataaacgntggtgctacgaccacncttntgtcc

SEQ ID NO: 170804 - DNA, 590 bp, Homo sapiens
  misc_feature: GYAE6OF01BO8CI.27.78.H01.1.454.CMB.1.raw
  modified_base (347)..(347): a, c, t, g, unknown or other
  misc_feature (347)..(347): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgacgggtcccctggagttcagtggcagtggatcnggacacatttccaccctacaccatcaaatacgcctaggaatcgtagaagatggctgactaaactttattacgtgtacctatacaagtaagttaccttaaccttttaccactaaagttcgaacttacctaacccttaccggaccaaacggggacaaccggactagggtaacgtaaacttaaaaccggaactttcggacgggtacctaggtacccaaccttagttacttcggttccctttaaccg

SEQ ID NO: 170805 - DNA, 554 bp, Homo sapiens
  misc_feature: GYAE6OF01EJXE0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacgtatttccaccctcacctatcaaatacgcctaggaagctagaagatgctagactaacgttattactgtacatcaagtaagtaccttaactttacctacaagtgtaactccacccttacggaccaagggaccacggacctaggaacgtaattaaacgaacttggtacggactacggtaccaactaatcgttcgtcttaccg

SEQ ID NO: 170806 - DNA, 659 bp, Homo sapiens
  misc_feature: GYAE6OF01BI3DV.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgactaccaaaggagaaagtcaccatcacctggccggccagtcagagcgttggtagtagcttacactggtaccagcagagccaggtcagtctcaaagctcctcatcaagtatgccttcccagttcccttctcgaccggggttcccctacggtacggttcaggttcgggctaggtggatcggtagggacctactactttccaccccttcgaaccctatacctaaagtaccgccgttagggaacgtcctaggaaagtacttacggaccttaggaacccttaaactttacttacgttacgtactaactacgtaacgtaacgttaaccttaaccttttaacccgagttaaacgttcgtaaccttacccgtaacccgttccggaaccccggaaacgggtacctaacccggtaacgtaacgggtaaacggttaaaccgttaaaaccggg

SEQ ID NO: 170807 - DNA, 661 bp, Homo sapiens
  misc_feature: GYAE6OF01DSGN2.27.78.H01.1.454.CMB.1.raw
  modified_base (290)..(290): a, c, t, g, unknown or other
  misc_feature (290)..(290): n is a, c, g, or t
tcagagcgtcgtctcacgaccggtgctcgatttagtgtgagtagtttgggttggggatgagcaaaactgacaagtcaaggcaggaagatgttgccatcacaactcattgggttctgctgctctggttccagcctccagggtgaattgtgctgactcagtctccagactttcagtctgtgactacgaaaggagaaagtcacgatcaccgtgccggcagtcagagcggttggtagtagcttacgactcggtaccagcaagaacgccgaggtcagtctaccaaagctccgtanactacaagtatcgtaccttccgacgttcctttcgacggtaccgggttcccctaggtaacggttccgaggttcggactaggtaggtactcggtaggacctactacgtttccaccctacaacctatactaaagtcgaccgtaggaagtcgtaaggaacgtgtacggactacggaacctttaaacttacgttaacgtcgtaactaacgttacgaacgttaacgttaaccttaactttaccgtaaccgtaagttctaacgtacctaacccggttcggaacccgtaacgggtacctacgtacgtaggtaacgtaacgttaaacgacggttcgtacggtctaccggtacctaccgtattccgttgttaccgttaccg

SEQ ID NO: 170808 - DNA, 507 bp, Homo sapiens
  misc_feature: GYAE6OF01ACVZ1.27.78.H01.1.454.CMB.1.raw
  modified_base (386)..(386): a, c, t, g, unknown or other
  misc_feature (386)..(386): n is a, c, g, or t
  modified_base (440)..(440): a, c, t, g, unknown or other
  misc_feature (440)..(440): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacactttcaccctcaccatcaaatagcctggaanctagaagatgctgcctaacttattactgtcatcagtagtactacttactcagtnatccacttccgacaagggcacgactggagtaacttaaagactggacgctgacaccatctgtcttacc

SEQ ID NO: 170809 - DNA, 624 bp, Homo sapiens
  misc_feature: GYAE6OF01C8B3J.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagcagaagccaggtcagtctaccaaagctcctcatacaagtatcgcttcccagtcccttcgtcctacggggtcccctcgaggttcgaggtggcaggtggagtcgtcgggactactactttccaccctacacccatacaaactacgaccgtaggaagcgtagaagatacggctagtctaactttattacttgtctagtacagtaacgttaccttaacttttaaccgtactaagtgtaacttcctaacccgttacggacccgtaacgggaacctaccggtaaccgtagggaaacgtaaacgtttaaaacccggacgttcgggacggtcctacggtaccctaccgtaacgtttccttagttccctttacccg

SEQ ID NO: 170810 - DNA, 553 bp, Homo sapiens
  misc_feature: GYAE6OF01AKVRP.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagctcctcatcaagtatgcttcccagtccttctcacggggtcccctcgaggttcaggtgcagtggatcgtggggacacatttccaccctcacccatcaatagcctaggaagctagaagatgctgactaacttattactcgtactatcagtacgtacttactttacctacaacgttcgattcctacccgttccggacccgaaacgggtaccaaccggaactacgggtaagtaacgttaaaaccgg

SEQ ID NO: 170811 - DNA, 600 bp, Homo sapiens
  misc_feature: GYAE6OF01ESJ94.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagctcctcatcaagtatcgccttccagtcccttctcgacgggtcccctggacggttcagtggcagtcggatcgtagggacactactttccacccttccaacctactacaagtacgccgtaggaacgcgtagaagatgctacgactaactttacttacgtactactactactaacgtacgttaacttacctttacccgtactaacgttgtaacttcctacccggtttaccgggaacccgtaaaccggggaacctaaccggaactacgggaaacgttaacgttaaaaaccggg

SEQ ID NO: 170812 - DNA, 522 bp, Homo sapiens
  misc_feature: GYAE6OF01BYBGF.27.78.H01.1.454.CMB.1.raw
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttccagtccttctcacgggtcccctcgagttcagtggcagtggatcgtgggacactactttccaccctcaccatcaatcgcctggaagctagaagntgctgctaacttnttactgtcatcagtagtacttactttacctataagtcgactctaccgttcggaccaagggacacgatggaagtattaaacgg

SEQ ID NO: 170813 - DNA, 659 bp, Homo sapiens
  misc_feature: GYAE6OF01DF2JH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgagggtgaattgtgctgactcagtctccagactttcagtctgtgactcaaaggagaaagtcaccatcacctgccggcagtcagagtcgttggtagtagcttacacgtggtaccagcagaagccaggtcagtctccaaagctcctacatcaagtactgccttacccagttccttctcgtacgggtcccctgtacggttcgacggtggacctaggtggtaatcgtagggaacctactacgttccaaccctcaaccctaataccaaatacggacccttagggaacgtactaggaaacgtagtcgacttaggaccttaaacttacttactagtactaatccaagtacgttaaccttaacgtttacctaactaagttacgtaactaccgttaaccgttaccgggaacccgaaagggtaccctaaacggtaccggttaggtaaacggtaaacgttaaaaaccggtaacgttacggttcggtaccttacgggaacctacccgtaattcccgttgttaccctttaaccg

SEQ ID NO: 170814 - DNA, 705 bp, Homo sapiens
  misc_feature: GYAE6OF01C44WB.27.78.H01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactacaaagganaaagtcaccatccaccgtggccggccagtcaggagtcggttaggtacgtacgtccttaacgacgttacgggtaccaggacaggaaacgcctaaggtcacgttacctaccaaagtcctacctacaattacaagtactcgcctttacccgtacgttcccttcgtacccggaccggggttcccctaggtacgggtttcaggttcggactaggttcgtacgtcggtacgggacctactactttacccaccctaccacctatacaagtaccgctaggaacgtcgtagaagtactcgtactagtaaccttaactttacgtttactacgttactaacttacgtacgttaacgtttaacctttaaaccctttaacgtacgtaagtttacgtaaccttacccgttaacccggttaccggaaccgaacgggtaaccgaaaccggttacggtaaagggaaaccggttaaaactttaaaacccggg

SEQ ID NO: 170815 - DNA, 558 bp, Homo sapiens
  misc_feature: GYAE6OF01COWO2.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagctcctcatcaagtatgcttcccagtccttctcacgggtcccctgagtcagtggcagtgatctgggacacatttccaccctcaccatacaatagcctaggaacgctagaaagatgctagctaacttattactgtactatcgagagttaacttaactttacctactaacgtgtattccgaacctttcggaaccaagggaccaacggtacgtaggaacgtaatttaaaaccggtaacgtttaggacttcgactaaccctattcccttgttcgtttaaccc

SEQ ID NO: 170816 - DNA, 520 bp, Homo sapiens
  misc_feature: GYAE6OF01D9I5J.27.78.H01.1.454.CMB.1.raw
  modified_base (384)..(384): a, c, t, g, unknown or other
  misc_feature (384)..(384): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtggacacatttcaccctcaccatcaatagcctggaanctagaagatgctgactaacttattactgtcatcagtagtactactttacctnaagtgatcaccttcggaccaagggaccacgactaggaacgtaacttaaacgactggtcgctacggcaacctatcgtgtcttacc

SEQ ID NO: 170817 - DNA, 517 bp, Homo sapiens
  misc_feature: GYAE6OF01BIO7B.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctcgaggttccagtggcagtggatctgggacacatttcaccctcaccatcaatagcctggaagctgaagatgctgcaacttattactgtcatcagtagtactactttacctactaagtgatcacctttacggaccaaagggcctaacgacgtaggacgaattaaacgaactgtaggctagcaccatctgtcttacc

SEQ ID NO: 170818 - DNA, 574 bp, Homo sapiens
  misc_feature: GYAE6OF01ETGPR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcaggtgagtcgtggactacgatttccacctccaccatacaatacgcctaggaacgctagaagtatgctcgactaacttattactgtcatcagtacgtactactttacctactaagtcgtactccgtacctttaccgggaccgtaaacgggaccaaccggtaccgtagggaacgtaaacgtttaaaaccgggaacttggtacggtaccgtacgaccacccattccgttgttcccttacg

SEQ ID NO: 170819 - DNA, 620 bp, Homo sapiens
  misc_feature: GYAE6OF01DI29T.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctcgaggggtgaaattgtgctgactcagtctccagtactttcagttctgtcgacctaccgaaaaggagaaagtccaccatccacctcggccgggcagtcagagcgttaggtagtagcttacacgtggtaccagcagaagccaggtcagtcctaccaaagcctacctcatcaagtatcgcttccacgttccttcgtcgacggggttcccctacggtacggttcgaaggtcggctaggttggactcgtacggggaactacgtactttccaacccctcaaccctatacaaagtacgcctagggaacgcgtagaagagtcgcgtagtaactaactttattacgttgtactatcaagtacttaacttaccttacctactaagttcgtacttaccgtacccgttacggacccaaacgggtaccgtaacggaaccgtaggaaacgtaacgttaaaaccgg

SEQ ID NO: 170820 - DNA, 498 bp, Homo sapiens
  misc_feature: GYAE6OF01E0QTQ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctcaagtgatccacttcggaccaagggacacgactggagattaaacgactgtagctgcacatctgtcttac

SEQ ID NO: 170821 - DNA, 610 bp, Homo sapiens
  misc_feature: GYAE6OF01CPTHP.27.78.H01.1.454.CMB.1.raw
  modified_base (283)..(283): a, c, t, g, unknown or other
  misc_feature (283)..(283): n is a, c, g, or t
  modified_base (420)..(420): a, c, t, g, unknown or other
  misc_feature (420)..(420): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaagtcacatcacctcgccggcagtcagagtcgttggtagtagcttacacgtggtaccagcaagagcaggtcagtctacaagctcctanactactaagtatcgccttcccagttccttactcgtacgggtcccctcggtaggttcaggtggcgaggtggatcgtaggacactacgttccaccctacacctatacaaacgtacgacctaggaacgtcgtagaacgtntacggctacgtacctaaacttagttactgtactactactaacgtacgttaaccttaactttacactaagtacgtactccgtacgttaccggaccgtaagggaccacggtacgtagggaaacgtaacgttaaaccggacgtcggtacggtctacggtacccacttaacttccgttacgttccgttaacccg

SEQ ID NO: 170822 - DNA, 512 bp, Homo sapiens
  misc_feature: GYAE6OF01BUDQC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttcaccctcaccatcaatagcctggaagctgaagatgctgctaacttattactgtcatcagtagttacttactttacctctaagtcgtatctaccttcggaccaagggacacgactggaagtacttaaacgactgtggctacgccacatctgtcttac

SEQ ID NO: 170823 - DNA, 639 bp, Homo sapiens
  misc_feature: GYAE6OF01A99XK.27.78.H01.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctggccggccagtcagagcgttggtagtagcttacactggtaccagcagagtcagtcagtctccaaagctcctcatcaagtatgccttcccagtcccttcgtccgacggggtccccctcggacggttcgagtcggcaggttggatccgtaggggtaacctaaacttttccaaccccgttcaaccctatacaaacttacggcccttaggaacgtcctagaacgtatcggctacggacctaaactttaattaccttgttacctaagttacctaacgtacgttaaccttaccttttaacctacctaaggttcgtaacttacccgtaacccgttcccggtacccgaaacggggtacccaacggtaacgttagggaaacgtaacgttaaaacggtaaccgg

SEQ ID NO: 170824 - DNA, 696 bp, Homo sapiens
  misc_feature: GYAE6OF01E08MN.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccaccgtgcccggccagtcagagcgttggtagtacgcttacacgtggtaccagacagacgccgaggtcacgtctaccaaagcctcctacatcaagtactcgtccttacccacgtttcctttccgtaccgtaccggggttcccccttacgggtaacggtttccagggttcggcgtacggtggtaacttcggtacggggtacctaaccttactttccccgaaccccttacccaacccctaagtaacctaacgtaccgtacccgtagggaaacgtcgtaaggaacgtacgtcgtacctagtaccttaaactttacttacttcgtacctagtactaacgttaacgttaacctttaacctttacctacgtaacgtcgtaaccttaccgtacccgttaccgggaaccgtaaacgggtaccgtacggtaacgtacggtaaacggtaaacgttaaaaccgg

SEQ ID NO: 170825 - DNA, 683 bp, Homo sapiens
  misc_feature: GYAE6OF01ERN4O.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccggcagtcagagcgttggtagtagcttacacgtggtaccagcagaacgccgaggtcacgtctaccaaagcctcctacatacaagtatcgtccttccacgttcccttcgtccgtacgggtcccctcggtacggttcgaggtcggcgtaggtggatcgtacgggactacgtactttccaccctcaacctatacaactacgcccgttaggaacgtcgtagaacgtagtcgacctacgtaccttaactttagtttaccgtcgttactaacgttaccgaagttacgtttaaacccgtttaacccttttaaccgtaacgtaacgttaccgtaacccgtttaccctaaaccccgggtttacccgggaacccggttaaaacggggtaaccccgtaaccggtaacggttaacgggtaaaacgttaaaccggttaaaaacccggg

SEQ ID NO: 170826 - DNA, 545 bp, Homo sapiens
  misc_feature: GYAE6OF01BBSXC.27.78.H01.1.454.CMB.1.raw
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgtgtcagtgcagtggatcgtgggacactactttcaccctcaccatacaatagcctggaacgctagaanatgctnacaacttattactgtacatcaagtgtaaccttactttacctataacgtgtatacctaccgttacggaccaagggaccacgacgtaggaacgtacgttaaacgaacgtggtacgctacggacctaccgtaatccgttgttccttacccg

SEQ ID NO: 170827 - DNA, 641 bp, Homo sapiens
  misc_feature: GYAE6OF01CCBUE.27.78.H01.1.454.CMB.1.raw
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgccttccagttccttctcacgggtcccctcgagttcagtggcagtgatcgngggacactnttccaccctcacctatacaatacgcctaggaacgcgtagaagtatcgacttgactaacttattactgtactatacgaagtacgttaaccttaccttttaaccctacgtaaagttcgtaaccttaccgtaacccgtttacccgggaacccgtaaaacggggtaacccaacccgggtaacggttacgggaaacggttaaacgtttaaaaaccggtaaccgtttagggtacgggtaccgttaccggaaccctaacccgtacgtttacccgttcggtttaacccc

SEQ ID NO: 170828 - DNA, 719 bp, Homo sapiens
  misc_feature: GYAE6OF01A1W51.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggcagtcagagcgttggtagtagtcttacactggtaccagcaagaagccaggtcagtcctaccaaagcctcctacatacaagtatcgtcccttcccacgtcccttccgtccgtacggggttccccctcggtacggttcgacggtggaccgtaggtcggacttcggtaggggtaacctacgtaaccttttcccgaccccttaccgtaaccctaactaccgtaaagttaccggaccggttaaggaacggtcgtaaggaaacgtagttcgtaccgtacggtacccttaaacgtttacgtttaaccgttacgttactaacgttaccgtaagttaacggtttaccctttaaccgttttaacccgtaacgttaaacggttacgtaccgttacccgtaacccgtttaccgggaacccgaaacggggtaacctaaccggtaacggtacgggtaaacggtaaacgtttaaaacccggg

SEQ ID NO: 170829 - DNA, 697 bp, Homo sapiens
  misc_feature: GYAE6OF01BS01R.27.78.H01.1.454.CMB.1.raw
  modified_base (299)..(299): a, c, t, g, unknown or other
  misc_feature (299)..(299): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggtagtagcttacactggtaccagcagaagccaggtcagtctccaaagcctcctcatcaagtntcgcttcccagtccttctcgacggggtccccctcgaggttcaggtggcaggtggatcgtgggacactactttccaccccttccaacctactactaaagtacgtacccgtggaacgtcgtaggaaacgtagtggaccttacggaccttaaactttaacttaaccgttcgttacctagttcctaaggtacgtttaacctttaacccgttttaaccctacgtaaacggttcgtaactttacccgtaacccgtttcccgggaacccgtaaacgggggtaacccaaacccgggtaaccgttaacggggtaacggttaaacgtttaaaacccgggtaaacgttacgggttacggacccgttacggtaccctaaacccgtacctttccgttcggttttaaccccg

SEQ ID NO: 170830 - DNA, 575 bp, Homo sapiens
  misc_feature: GYAE6OF01BSSMY.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagttccttctcgacggggtccccctcgtacggttcaggtggcaggtggatcgtgggacacgatttcacccctcaccatcaatagcctggaagctagaagatgctgactaacttattacctgtacatcagtagttactactttacctctaagtgtacttaccgtaccgttaccggtacccgaaagggtaccaaccggaacgttacgggaagtaacgtttaaaacggacgttacgtggtaccttcggaccaccctacttcgttggttaccc

SEQ ID NO: 170831 - DNA, 510 bp, Homo sapiens
  misc_feature: GYAE6OF01AQA93.27.78.H01.1.454.CMB.1.raw
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggagtagcttacactggtaccagcagaagccaggtcagtctccaaagctcctcatcaagtatgcttcccagtccttctcagggtccctcgaggttcagtgcagtggatctgggacacatttcaccctcaccatcaatagcctggaagctgaagatgctgctaacttattactgtcatcagagtactactttacctcaagtnatcaccttcgaccaaggtacacgactaggaagaacgttaaacgaactcggtaggctagacaccgatctgtcttac

SEQ ID NO: 170832 - DNA, 535 bp, Homo sapiens
  misc_feature: GYAE6OF01DA7CX.27.78.H01.1.454.CMB.1.raw
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (476)..(476): a, c, t, g, unknown or other
  misc_feature (476)..(476): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttccagtccttctcgacggggtcccctgaggttcagtggcagtgatcgtgggacacntttcaccctcaccatacaatcgcctaggaacnctagaagatgctgactaacttagttactgtcatcagtagtacttaacttacctanaagtgactcctaccttacggacccgaagggaccaacggactaggaagtaagttaaaacg

SEQ ID NO: 170833 - DNA, 576 bp, Homo sapiens
  misc_feature: GYAE6OF01A3MVJ.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggcagtcagagcgttggtagtagcttacactggtaccagcagaagccaggtcagtctccaaagcctcctcatcaagtatgccttccagtccttctcgacggggtccctcgaggttcagtgcagtgatcgtcgggacacgtattccacctcaccactcaacgtacgaccctaggaacgctagaacgtagtcgcttagacctaattacttacgttcgtactacttacgacgtacgttaacctactttaccctcgtaaacgtcgtactaccgttacccgttacggaccgtaaacgggaccacggaacgtacggaagtaacgttaaaaccgg

SEQ ID NO: 170834 - DNA, 575 bp, Homo sapiens
  misc_feature: GYAE6OF01C6ZRI.27.78.H01.1.454.CMB.1.raw
  modified_base (540)..(540): a, c, t, g, unknown or other
  misc_feature (540)..(540): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatccacctgccgggccagtcagagcgttggtagtagcttacactggtaccagcaagaagccaggtcagtctccaaagctcctcatcaagtatgcttcccagtccttctcgacggggtcccctcgtaggttcaggtggcagtggatcgtgggacactatttccacccctcaacatactaaatacgccgtaggaacgcgtagaagatgcttagactaactttattactgtacatcagtacttaacttacctttaacctacgtaagtgtactacctacccgttaccggacctaacggggaccaacgacgtaggaagtaacgttaaacgagttacggnggtactacgtaccaacgtattctcgttccttaccg

SEQ ID NO: 170835 - DNA, 512 bp, Homo sapiens
  misc_feature: GYAE6OF01ETI7P.27.78.H01.1.454.CMB.1.raw
  modified_base (369)..(369): a, c, t, g, unknown or other
  misc_feature (369)..(369): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctnaccatcaatacgcctggaagctgaaagatgctgactaacttattactgtcatcagagtacttactttacctcaagtgattcaccttcggaccaagggaccacgactggatattaaacgactgtaggctcgcaccntctgttcc

SEQ ID NO: 170836 - DNA, 588 bp, Homo sapiens
  misc_feature: GYAE6OF01CKHFS.27.78.H01.1.454.CMB.1.raw
  modified_base (396)..(396): a, c, t, g, unknown or other
  misc_feature (396)..(396): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggccagtcagagcggttggtagtagcttacactggtaccagcagaagccaggtcagtcctaccaaagctcctcatcaagtatcgccttcccagttccttctcgacgggtcccctcgaggttcagtggcagtggatcgtgggacacgtactttccaccctcacctatcaatacgcctagganctagaagatcgactgactaatttatactgtacatacgagtagttacttactttacctaactaagtacgtactctacccgttcggaccgtaagggacctaaccgacgtagggaacgtaaacgttaaaccggacgttacggtacgggtacttaccggacctaaacccgtatttaccgttcgtttccttaacccg

SEQ ID NO: 170837 - DNA, 559 bp, Homo sapiens
  misc_feature: GYAE6OF01AWDZF.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatcgacttcccagtcccttctcgtacgggggttccccctcggacggtttcgaggtcgggacaggttggatcgtaggggacactactttccaaccccttcacctaatccaaattacggcccttaggaacgctgaagatgcctagcctaacttatactgtacatcagtattactacttacctatagtcattcaccttccggaccaacggtacacggaactggaacgtaataaaccg

SEQ ID NO: 170838 - DNA, 584 bp, Homo sapiens
  misc_feature: GYAE6OF01BF637.27.78.H01.1.454.CMB.1.raw
  modified_base (423)..(423): a, c, t, g, unknown or other
  misc_feature (423)..(423): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagctttacactggtaccagcagaagccaggtcagtctaccaaagctcctcatcaagtatgacttcccagtccttctcgacgggtcccctgacggttcagtggcagtgagtcgtgggacacgtactttccaccctcaccatcaaatacgctaggaagctagaagtatgctgactaacttattactntcatcgagtacgtacttactttacctactaagtgtaactctacccgtttaccgggaccgaaacgggtacaaccggtacgtaacgggtaacgtaacgtttaaaaccgaacggttacgttacggacgttacgaccgaacctacttaccgttgttcttaacccg

SEQ ID NO: 170839 - DNA, 500 bp, Homo sapiens
  misc_feature: GYAE6OF01BKE4X.27.78.H01.1.454.CMB.1.raw
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcagtggcagtggatcgtgggacactatttccaccctcaccatcaatacgcctggaagctagaagatgctgactaacttattactgtcatcagtactactacttactnaagtnatcaccttcgacaaggcacgactggagacttaagactgngntcgacacatctgtctc

SEQ ID NO: 170840 - DNA, 584 bp, Homo sapiens
  misc_feature: GYAE6OF01AXO0Y.27.78.H01.1.454.CMB.1.raw
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtcncaagctccncatcaatntcgcctccagtccttctcgacgggtcccctggacgttcagtgctaggtggatcgtagggacacgtactttaccaccctcaccctataccaatacgcctaggaacgctagaagatgctagtctaacttnttactgtacagtacacgtacgttaacttacgtttaacctagtaacgttntacttaccctaacccgttaccggacccgaaacgggtaacccaaccggtaaccggtaaggtaaacggttaaacgttaaaaacccgg

SEQ ID NO: 170841 - DNA, 655 bp, Homo sapiens
  misc_feature: GYAE6OF01B8A1Z.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagtccttctcgtacgggtcccctcggaggttcagtggcagtggatcgtgggacactactttcaccctcaccataccaaatacgcccgtaggaacgcctaggaagagttcgacctagacctaaacgtttactttaacgtgttcaatcctaacgtaacgtttaaccttaaccttttaccctaacgtaaacggttcgtaacttccctaacccgtttaccgggacccgtaaacggggtaaccctaaccggtaccgttagggaacgtaaacggtttaaaaccggaacgttggttaccgggtacccttacgggtaccctacccgtaacgtttccgttacggtttaccctttaaccccg

SEQ ID NO: 170842 - DNA, 579 bp, Homo sapiens
  misc_feature: GYAE6OF01BRQL4.27.78.H01.1.454.CMB.1.raw
  modified_base (464)..(464): a, c, t, g, unknown or other
  misc_feature (464)..(464): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgtccttcccacgtccttctccgacgggtccccctcgtacggttcagtggcaggtggatcgtgggacacgtactttccaccctcaccatcaatacgcctaggaacgctagaagagtgctgactaactttattactgtcatcagtactacttactttacctctaagtnactcctaccgttacggaccgaacgggaccgaacgtaccgtagggaacgtaacgttaaacggtaaccgtggtacggtaccgttcggacctaacccgtacttccgttcgtttacccg

SEQ ID NO: 170843 - DNA, 546 bp, Homo sapiens
  misc_feature: GYAE6OF01CJZ4L.27.78.H01.1.454.CMB.1.raw
  modified_base (433)..(433): a, c, t, g, unknown or other
  misc_feature (433)..(433): n is a, c, g, or t
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccagtcagtctccaaagctcctcatcaagtatgcttcccagttcccttctcgacggggtcccctcggtacggttcaggtcggcaggtggatcgtgggacacgtatttccacccttcacctatcaatacgcctaggaanctagaagatgctagctaacttattactntacatacagtactacttacttacctntaacgtntactcctaccttacggaccaagggaccaacgagtacggataacgttaaacgg

SEQ ID NO: 170844 - DNA, 713 bp, Homo sapiens
  misc_feature: GYAE6OF01BGIO6.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtcctccagtactttcagtctgtgactacaaaggagaagtcaccatcacctcggccggcagtcgagagtcgttggagtagacttacacgtggaccagacagaacgccaggtcagtcctaccaacgcctcctcatacgaatagtcgccttcccgacgttcccttcgtccgtaccgggttcccctaggtacggttccgaaggttcggacgtaggtacggtactcggtacgggaacctaaccgttacgtttaccccaccccttacccgtacctaaccttaaccgtaaacgttaccggacccgttaagggtaaacgtcccgttaaaggtaacgtacgttacgacccgtttacggaacctttaaaccgtttacgtttaaaccgttcggttaaccacgttaaccgtaacggtaacctttaaaccgttacctttaaccgtactaacggttgtaaccctacggtacccgttaccggaacccggaaggtaaccgacgtaacgtaggaaacgtaagttaaaacccgg

SEQ ID NO: 170845 - DNA, 602 bp, Homo sapiens
  misc_feature: GYAE6OF01DBYMR.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagagccaggtcagtctcaaagctctcatcaagtatgcttcccagttccttctcgtacgggtcccctcggtacggttcaggtggcaggtgagttcgtgggacactacgtttccacccttcaccatacaagtacgcctaggaacgctaggaagatacgcgttagactaaacgtttacttactgtactattcaagtagttaaccttactttaacctacctaagttacgtaactacctaccgttaccggacccgtaaacggggtaaccacggtaacgttacgggaaagttaaacgttaaacgaacgttggtacggtactacggtacctacctattcgtgttccttaccg

SEQ ID NO: 170846 - DNA, 580 bp, Homo sapiens
  misc_feature: GYAE6OF01CRYXM.27.78.H01.1.454.CMB.1.raw
  modified_base (567)..(567): a, c, t, g, unknown or other
  misc_feature (567)..(567): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagactttcagtctgtgactaccaaagggagaaagtcaccatccacctgccgggccagtcagagcgttggtagtagcttacacgtggaccagcagaagccaggtcagtctaccaaagctcctcatcaagtatgccttcccagttccttctcgacgggtcccctcggagttcagtggcagtggatcgtgggacactacttccacccctcaccatacaatacgtcctaggaacgctagaagatcgactcgactaactttattaacttcgttacatcgtaagtacttaaccttacctttaacctataacgttacgtattaccgtacgttaccggaccgtaaaggacctaccgaagtggaaacggttaacttaaaacgacgttcggtagtctacgaccaccgtnttctgttcttacc

SEQ ID NO: 170847 - DNA, 557 bp, Homo sapiens
  misc_feature: GYAE6OF01DBDJ7.27.78.H01.1.454.CMB.1.raw
  modified_base (457)..(457): a, c, t, g, unknown or other
  misc_feature (457)..(457): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctttctcgaggggtcccctcgacggttcagtggcagtggatctgggacactatttccacccctcaccatacaatacgcctagggaacgtcgtagaagtagtgcgtagacgtaactttattactgtacatcagacgttacttactttacctntaagtgtatcctaccgttcggacaacgggacacgacgtaggagtaaacgttaaacgaacgttggtacggtcgtacgaccaccagttctgttcgttacccg

SEQ ID NO: 170848 - DNA, 545 bp, Homo sapiens
  misc_feature: GYAE6OF01EGCZC.27.78.H01.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (456)..(456): a, c, t, g, unknown or other
  misc_feature (456)..(456): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccgaggggtgaattgtgctgactcagtctccagtactttcagtctgtgactaccgaaaggagaaagtcaccatcacctgccggcagtcagagcggttggtagtagcttacactcggtaccagcaagaagccaggtcagtctaccaaagctcctcatacaagtatcgtccttcccacgttccttctcgacgggtccctgagttcagtcgcagtgatcgtaggacactacttccaccctcaccatacaatacgctaggacnctagaanatgctgactaacttattactgtctatcagtattaccttacttaactactaagtntactaccgtaccgttacggaccgaaggaccacgacgtaggaacgtaagttaaacgagttggtcgactcgtacacatcttcgtcttaccg

SEQ ID NO: 170849 - DNA, 608 bp, Homo sapiens
  misc_feature: GYAE6OF01AHJIR.27.78.H01.1.454.CMB.1.raw
  modified_base (331)..(331): a, c, t, g, unknown or other
  misc_feature (331)..(331): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaacgtcaccatccacctggccgggccagtcagagcgttggtagtagcttacactggtaccagcagaagccaggtcagtctccaaagctcctcatcaagtntcgccttccacgtccttcgtcgacgggtcccctcggacggttcacggtcgcaggtggattcgtagggtaactaacgtttccaccctacgacctactacgtaactacgtaccgtacggtaagccgtaggaagtacgtcgtactacgtacttaacctttattacgtacgtacgtacttacgaagtacttaaccgttacttacctacgtaagttcgtactacctaccgttccggaccgtaacggacgtaacgacgtaaggacgtaaagtaaacggtacgg

SEQ ID NO: 170850 - DNA, 507 bp, Homo sapiens
  misc_feature: GYAE6OF01DT0IH.27.78.H01.1.454.CMB.1.raw
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttccaccctcaccatcaatagcctggaacgctagaagatgctagactaactttattactgtcatcagtagtactactttacctcaagtgactcaccttcggaccaagggacacgactaggagattaaacgactgngcngccacntctgtctac

SEQ ID NO: 170851 - DNA, 649 bp, Homo sapiens
  misc_feature: GYAE6OF01CG71U.27.78.H01.1.454.CMB.1.raw
  modified_base (148)..(148): a, c, t, g, unknown or other
  misc_feature (148)..(148): n is a, c, g, or t
  modified_base (288)..(288): a, c, t, g, unknown or other
  misc_feature (288)..(288): n is a, c, g, or t
tcagagcgtcgtctcacgaccggtgctcgatttagtgtgagtagtttggggttgggggcatgagcaaaactgacaagtcaaggcaggaagatgttgccatcacaactcattgggtttctgctgctctgggttccagcctccaggggtnaaattgtgctgactcagtctcagactttcagtctgtgactacgaaaggagaaacgtcaccatccaccgtggccggcagtcgagagtcgttggtagtagcttacacgtaggtaccagacaggacgcaggtcagtctacaanctctacatcaagtatcgtccttaccagttcccttacgccgtaccgggtcccctacggtacggtttacagtcggcaggtcggaatcggtacgggtaactacgtacttccacccttcaccgtatacaagtacgaccgtaggacgacgtagaagtgtcgacttagacttaactttacttacgtagtacagtaccgtaagtacgttaaccttactttactacgtaagtactacttacccgtaaccgttaccggaaccgtaaacgggacctaccggtaacgtacgggtaaacgtaacgttaaacggaacgttcgggtaacggtaccgttaccgaacccttaaccgtacgttcgtccggtttaaccc

SEQ ID NO: 170852 - DNA, 516 bp, Homo sapiens
  misc_feature: GYAE6OF01EXPKE.27.78.H01.1.454.CMB.1.raw
  modified_base (400)..(400): a, c, t, g, unknown or other
  misc_feature (400)..(400): n is a, c, g, or t
  modified_base (456)..(456): a, c, t, g, unknown or other
  misc_feature (456)..(456): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgcttcccagttcccttctcgacgggtcccctgtacggttcagtggctaggtgatcgtagggacacgtattccaccctcacatacaatacgcctaggaanctagaagatgactgactaacttatactgtcatcagtagtacttacttacacaagtnactcaccgtcgacaaggacacgatagagtataaacgactgcgctgacacnttcgnttacc

SEQ ID NO: 170853 - DNA, 536 bp, Homo sapiens
  misc_feature: GYAE6OF01EF4XQ.27.78.H01.1.454.CMB.1.raw
  modified_base (395)..(395): a, c, t, g, unknown or other
  misc_feature (395)..(395): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgtttggtagtagcttacactggtaccagcagaagccaggtcagtctccaaagctcctcatcaagtatgccttcccacgtccttctccgacggggtcccctcgtaggttcagtcggcagtggatcgtgggacactatttccaccctcaccatacaatagcctggaanctagaagatgctgactaacttacttactgtcatcagtacgtacttactttaacctactaagtgtactcctaccttcggaccaagggacacgacgtaggaagtaattaaacggaactgtacggctcgacacatctgtcttac

SEQ ID NO: 170854 - DNA, 549 bp, Homo sapiens
  misc_feature: GYAE6OF01D9PDA.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcaggtggcaggtggatcgtgggacactatttccaccctcaccatacaatacgcctaggaagctagaagatgctgactaactttattactgtcatcagtacgtacttactttacctactaagtctactcctaccgttccggaccgaagggacctacggactagggaacgtaacgttaaacggactcggtaggctcgacacctacttctcgttaccc

SEQ ID NO: 170855 - DNA, 599 bp, Homo sapiens
  misc_feature: GYAE6OF01BB1RB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggatagcttacactggtaccagcagaagccaggtcagtctccaaagctctcatcaagtatgcttcccagtccttctcagggtccctcgagttcagtgcagtgatcgtgggacactatttcaccctcacctatcaatagcctggaagctagaacgatgctagtactaacttacttactcgtactatacctaagtacgttacttaacctttacctacctaagttacgtactaccgtaccgtttaccggaacccgtaacgggaacgtacccggtaacgttacgggaaacgtaaacgtttaaaacggaaccttaggttacgggaccgttacggtaccctaaaccctaacgttccttggttaccctttaacccg

SEQ ID NO: 170856 - DNA, 702 bp, Homo sapiens
  misc_feature: GYAE6OF01B8JDB.27.78.H01.1.454.CMB.1.raw
  modified_base (312)..(312): a, c, t, g, unknown or other
  misc_feature (312)..(312): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgcttcccagtccttcncgacgggtcccctcgtaggtcagtggcagtggatcgtgggactcgactttccaccctcaccatacaaatacgccgtaggaacgacttaggaagtatagacttaggaccttaaacgtttactttaacgtacgttacctaacttaccgaaaggttacgttaaccctttaaccgtttttaccccttaacgtaacggttacggttaaccttacccggttaaaccccgttttacccgggaacccggtaaaaccgggggtaacccgaacccgggttaaaccgttaaacggggtaaacgggttaaaacctttaaaacccgggaaactttagggggtacccgttacggtaccgtacccgtaaaccctagtttacccgttcgtttaccgtttaaccccg

SEQ ID NO: 170857 - DNA, 574 bp, Homo sapiens
  misc_feature: GYAE6OF01BQHA0.27.78.H01.1.454.CMB.1.raw
  modified_base (195)..(195): a, c, t, g, unknown or other
  misc_feature (195)..(195): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctaccaaagctcctcatcaagtatcgccttcccagtccttctccgacggggtcccctcggtaggttcagtggcagtggatcgtgggacactactttccaccctcacctataccaaatacgccctaggaacgtctagaagtatgactagactaactttattactgtacactanagtacgttacttactttacctataagtgtacttctacccgttcggaccgaagggaccaacgtacgtaggaagtaacgttaaacgaacgttggtacggtcttacggcctaacctattcgtcgttcttacccg

SEQ ID NO: 170858 - DNA, 536 bp, Homo sapiens
  misc_feature: GYAE6OF01B4I41.27.78.H01.1.454.CMB.1.raw
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagcctcctcatcaagtatgcttcccagtccttctcacggggtccctcgaggttcagtgcagtggatcgngggacactatttccaccctcaccatcaatacgcctagggaanctagaagtctgctgactaacttattactgtcatcagtacttactactttaccacaagtcaactctaccgttcggacccgaagggaccaacgacgtaggaagtaacgttaaaacgg

SEQ ID NO: 170859 - DNA, 690 bp, Homo sapiens
  misc_feature: GYAE6OF01AED83.27.78.H01.1.454.CMB.1.raw
  modified_base (144)..(144): a, c, t, g, unknown or other
  misc_feature (144)..(144): n is a, c, g, or t
  modified_base (193)..(193): a, c, t, g, unknown or other
  misc_feature (193)..(193): n is a, c, g, or t
tcagagcgtcgtctcacgaccggtgctcgatttagtgtgagtagtttgggtttgggatgagcaaaactgacaagtcaaggcaggaagatgttgccatcacaactcattgggttctgctgctctgggttccagcctccaggggtnaaattgtgctgactcagtctccagactttcagtctgtgactcaaagganaagtcacatcaccgtgccggcagtcagagcgttgagtagcttacacgtggtaccagcagaacgccaggtcacgtctaccaaagcctaccgtcactactaagtactcgtccttcccagttcccttcgtcgacggggttcccctggacggttcgaggtcggcgtaggtcggacttcgtcggactacctagtttccaacccctactaaccctatacgtaaacgtacgaccgttaggaacgtacgttagggaaagtacgtagacgttacgaccttaaacgttatttaaccgtggttaccaattccgaagtaacggttacctttaaccttttaacccgtactaaacggtttacgaacttaccgtaacccgttccgggtacccgaaaggggtaccctaacgggtaacgtacgggtaaagtaaaccgtttaaaaaccggtagttacgggttacgggtactaccgggtacctaaccgtaccgttactttcggtaccttttacccg

SEQ ID NO: 170860 - DNA, 532 bp, Homo sapiens
  misc_feature: GYAE6OF01DN6WG.27.78.H01.1.454.CMB.1.raw
  modified_base (438)..(438): a, c, t, g, unknown or other
  misc_feature (438)..(438): n is a, c, g, or t
  modified_base (520)..(520): a, c, t, g, unknown or other
  misc_feature (520)..(520): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgagttcagtggcagtggatcgtggacactatttccaccctcaccatcaatacgcctaggaagctagaagtatgctagactaactttattactgtcatcagtatacttacttaccntaagtgtactctaccttcggacaagggaccacgacgtaggaacgtaacgttaaacgattggtacggtactcggtacaacctntcctgtccttac

SEQ ID NO: 170861 - DNA, 599 bp, Homo sapiens
  misc_feature: GYAE6OF01D5U8G.27.78.H01.1.454.CMB.1.raw
  modified_base (147)..(147): a, c, t, g, unknown or other
  misc_feature (147)..(147): n is a, c, g, or t
  modified_base (354)..(354): a, c, t, g, unknown or other
  misc_feature (354)..(354): n is a, c, g, or t
  modified_base (581)..(581): a, c, t, g, unknown or other
  misc_feature (581)..(581): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtnaaattgtgctgactcagtctccagactttcagtctgtgactccaaaggagaaagtcaccatccacctgccggccagtcagagcgttggtagtacgctttacacgtggtaaccagcagaagccaggtcagtctaccaaagcctacctcatcaagtatcgcttcccagtccttctcgacgggtccctggtagtcagtgcaggtgatcgnggacacgtacttccaccctacacctatacaaatacgaccttaggaacgcgtaagaagtatcgactacgtactaaactttacttactgtacagtactaagttaacttacgttaactttaccgacgtaaacgttcgtaacttcctaaccggttccggaccgtaaagggtaccaccggtagtacggaagtaaacgttaaacgtacgtggtacgaccgtcgacctaacctnttacgttgtacttacccg

SEQ ID NO: 170862 - DNA, 520 bp, Homo sapiens
  misc_feature: GYAE6OF01CX145.27.78.H01.1.454.CMB.1.raw
  modified_base (367)..(367): a, c, t, g, unknown or other
  misc_feature (367)..(367): n is a, c, g, or t
  modified_base (444)..(444): a, c, t, g, unknown or other
  misc_feature (444)..(444): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttcaccctnaccatcaatagcctggaacgcgtagaagatgctgctacttattactgtcatcagtagtactactttacctacaagtnactctaccttcggacccgaagggaccacgacgtaggacgattaaacgactgtaggactgacaccactcgtgttacc

SEQ ID NO: 170863 - DNA, 491 bp, Homo sapiens
  misc_feature: GYAE6OF01A7N5T.27.78.H01.1.454.CMB.1.raw
  modified_base (431)..(431): a, c, t, g, unknown or other
  misc_feature (431)..(431): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcagggtccctcgagttcagtgcagtgatcgtggacactatttcaccctcaccatacaatacgccgtaggaagctagaagatgctagactaacttatactgtcatcagtatactacttacanagtgactcacttcgacaaggcacgataggagacttaagactgngcngcacatctntctac

SEQ ID NO: 170864 - DNA, 548 bp, Homo sapiens
  misc_feature: GYAE6OF01EK1WH.27.78.H01.1.454.CMB.1.raw
  modified_base (230)..(230): a, c, t, g, unknown or other
  misc_feature (230)..(230): n is a, c, g, or t
  modified_base (328)..(328): a, c, t, g, unknown or other
  misc_feature (328)..(328): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctccaaagcctcctcatcaagtntgccttcccagtccttcgtccgacggggtcccctcgaggttcaggtcggcaggtggacgtcgtagggacactactttccacccttacacccatacaatacgacctaggaagctagaagatcgctgactaacttattactntacatacagtactacttactttaccataagtcgatccaccttcggaccaacgggacaacggactgggataagttaaacgg

SEQ ID NO: 170865 - DNA, 723 bp, Homo sapiens
  misc_feature: GYAE6OF01EHPTY.27.78.H01.1.454.CMB.1.raw
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctctgggttccagcctccaggggtnaaattgtgctgactcagtctccagactttcagtctgtgactaccaaaagganaaagtcaccatccacctgccggcagtcagagcgttggagtagcttactactggtaccagcaagaacgccaggtcagtctaccgaaagcctcctcatcaaagttcgacctccgagtccttacgtctacggggtccccctacggacggtttcgaacggtcggactacggtggtattccgtacggggtaaccaaccgtaactttttacccgaaccccccttacgtaaccccaaagttaccgtaaacgttaaacccggacccccgggtaaaagtccgttaacggaaagtaactcggtaccctaggaaccttaaaccgtttaactttaaccgttgggtacctaagttacccgaagttaaccgttaaaccttaacccctttttaaccctacgtaaaaggtcggtaaccttacccgtaaacccgtttccgggaacccgtaaaacggggacctaaccggtacgtaacgggtaagtaaaaccgttaaaaaccggaaaccg

SEQ ID NO: 170866 - DNA, 803 bp, Homo sapiens
  misc_feature: GYAE6OF01DDZD7.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccgggccagtcagagcgttggtagtagcttacactggtaccagcaagaacgccgaggtcagtcctaccaaacgcctcctacatactaagtatcgtccttcccacgttcccttcgtccgtaccggggttccccctcggtacgttcgaggtcggcgtaggtcggtacgttcgtacgggaactaacgtactttccaaccccttaccaaccctaataaccgtaaagtaccggtacccgtagggaaacgtccgttaaggaaacgtacttcggtaccgtacggtaacctttaaacctttaacgtttaccgttacggttacctaacttaaccggtaacggttaacgttttaaaccctttaaccctttttaaacccgaacgttaaacgggtttacgtaaccttaccccggttaaacccgtttacccggggaaacccggtaaaacggggtaaaccctaaccgggtaaacggttacggggtaaaaccggttaaaacgtttaaaacccgggtaaacggtttccgggtaaccgggttacccgtaaccggttaacccgtaaacccttacgtttccggttttaggttaacccctttaacccg

SEQ ID NO: 170867 - DNA, 635 bp, Homo sapiens
  misc_feature: GYAE6OF01C1FUO.27.78.H01.1.454.CMB.1.raw
  modified_base (180)..(180): a, c, t, g, unknown or other
  misc_feature (180)..(180): n is a, c, g, or t
  modified_base (335)..(335): a, c, t, g, unknown or other
  misc_feature (335)..(335): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtgacctaccgaaaggaagaaagtccaccatccaccgtggccgggccagtcagagtcgttggtagtagtcttacacgtcggtaccagcagaacgccaggtcagtcaccaaagctacctnatacaagtactcgcttacccagttcctctcgaccgggtcccctaggtacgttcaggtcgctaggtggatcgtgggactactacgtttccacccgtacactatacaagtacgcctagggaactcgtagaacgtgtcgctacgtacttaactttagttactacgtactacgttaacgagtaaccgttacctttaaccgtttacctacgtaaggttacgaacctttaccggtaccccgtttacgggaacccgtaacgggaacctaacggtaacggtaacggtaaagttaaacgttaaacccgg

SEQ ID NO: 170868 - DNA, 664 bp, Homo sapiens
  misc_feature: GYAE6OF01DA7E3.27.78.H01.1.454.CMB.1.raw
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatcacctgccggccagtcagagtcggttaggtagtagtcttacactcggtaccagcaaggaagccgaggtcagtcctaccaaagtcctcctacatacaagtatcgtccttccctacgttcccttctccggaccggggttcccctcggtacggttcaggtcggacgtaggtaggtacgtcgtacgggtaacctaccttacttttacccaccccgttaccaaccctaactaacctaaacgtcgacccgttaagggaacgtccgtaaggaagtagtcgtaccttagaaccttaactttattacgttgtactatacgtagttaacgttaacctttaaccttacctacgtaagttacgacttccgtaacccgttaccggaaccgaacgggtaaccacggtacgtaaggtaacgtaaagttaaaccgg

SEQ ID NO: 170869 - DNA, 562 bp, Homo sapiens
  misc_feature: GYAE6OF01C0RC6.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaagctcctacatacaagtatcgcttcccagttcccttctcgacggggtcccctcggtaggttcagtggacaggtggagtcgtgggacactactttccaccctcacccatacaatcgaccgtggaacgctagaagatgctagacctaacttattactgtactatacagtacgttaccttactttacctagtaacgtgtactcctaccgttccggaccgaagggaccacggtacgtaggagtaacgttaaacgg

SEQ ID NO: 170870 - DNA, 578 bp, Homo sapiens
  misc_feature: GYAE6OF01BOJAK.27.78.H01.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccggccagtcagagcgttggtagtagcttacactggtaccagcagaagccaggtcagtcctcaagcctcncatcaagtntnctccagtcctcncgacgggtccctgacgtcagtgcagtgatcgaggactacgtcttccaccctacaccactacaagtcgccgtagaacgtctagaacgtntcgctagactaacgtttacttacgtagtacctatacgtaagtacgttaaccgttacctttaccgtataacggtcgtactccgttaacccgttcggacccgtaaacgggacctaacggtacgtaggtaaacgtaacgttaaacggtaacgg

SEQ ID NO: 170871 - DNA, 796 bp, Homo sapiens
  misc_feature: GYAE6OF01B6VKG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccgaaaggagaaacgtcaccatccaccgtcgccgggccagtcgagagcgttggtagtagtcttacactggtaccagcaagacgccaggtcacgtacctaccaaagtcctcctacatactaagtactcgtccttccgacgttcccttcgtacgtaccggggttccccctacggtacggttacgaggtacgggcgtaggttcggacttcgggtacgggaaccgtacttactttccccgacccctacctaaccctaattacctaaacgttaaccggaccgtacggaaacggtccttaaggaacggtaattcggtacgttacggtaacccttaaacgttttacgtttaccgttacgttaaccctaagtttaccggaacggtttaacgtttaaaccccgtttaaaccggttttaacccttaaacgtaaaccggtttacgttaaacccgtttacccccgtttaaaccccgggttaccccgggtaaaacccgggttaaaccccggggtaaaccgtaaaccccggggtaaacccggtttaaacggggtaaaacggtttaaaacccggttaaaaaacccggggg

SEQ ID NO: 170872 - DNA, 535 bp, Homo sapiens
  misc_feature: GYAE6OF01BXT4H.27.78.H01.1.454.CMB.1.raw
  modified_base (199)..(199): a, c, t, g, unknown or other
  misc_feature (199)..(199): n is a, c, g, or t
  modified_base (464)..(464): a, c, t, g, unknown or other
  misc_feature (464)..(464): n is a, c, g, or t
  modified_base (529)..(529): a, c, t, g, unknown or other
  misc_feature (529)..(529): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggaccagtcagagcgttggtagtagcttacactggtaccagcagaagccaggtcagtctaccaaagcctcctcatcaagtatcgcttcccacgtccttctcgacggggtcccctcgacggttcaggtggcaggtggatcgtgggacactatttccaccctcaccatacaatagcctggaacgcgtagaaagatgctagactaacttattactgtacatcagtacgttactacctttactactagtnactcaccgttcgaccgaagggacacgtacgaggaagtaataaacggactgtgactgaccactctntgttac

SEQ ID NO: 170873 - DNA, 494 bp, Homo sapiens
  misc_feature: GYAE6OF01CWKH6.27.78.H01.1.454.CMB.1.raw
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggtcagtggcagtgatctgggacacatttcaccctcaccatcaatagcctggaanctgaagatgctgcaactttatactgtcatcagagtacctactttacctnaagtgatcaccttcggccaaggaccagactggagataaacgaactgngctgcaccatctgtcttc

SEQ ID NO: 170874 - DNA, 728 bp, Homo sapiens
  misc_feature: GYAE6OF01CVP0E.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctcgtgggttccagcctcgaggggtagaattgtgctgactcagtctcagtacttcagtctgtcgactaccgaaaggagaaacgtccaaccatccaccgtcggccgggaccagtcaggacggtcggttaggtagtacgtcttaacgacgtacggtaaccagacgaaggaaacgccgtaagggtaccacggttacctaacccgaaaagtccttacctactaacttaacgtaaacggtattccgtcctttaccctacgtttcccttacgttacccgggacccgggtttccccgttacggtacggtttcgacggtcggacgtacggtaggtactcggtacgggacctacgtacctttaccaaccctcaaccctactacgtaaactacggtacgtagggaacgtcgtaaggaagtcgtacgcttacggtaacttaacgtttacttacgtacgtactactacgtacgtaaccgttacttaaccttactacgtaagttacgtaacgttacccgtaccggtaccgaacccgagggtaaccctaacgggtaacgttacgggaaacgttaaacgttaaaccggg

SEQ ID NO: 170875 - DNA, 730 bp, Homo sapiens
  misc_feature: GYAE6OF01AQ865.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctggccggcagtcagagcgttggtagtagcttacactggtaccagcagaagccaggtcagtctaccgaaagcctcctcatcaagtatgccttcccagttccttctcgtacggggtcccctcggtacggttcacggttggctaggttcggactcgtcggggaacctacgtacttttaccgaccccttccgaaacccacttacctaaacgttaccggaccccgttaaggggaaaccgtaccgttacgggaaacgtaacgttacggtaccgttacggtacccttaaaactttttaccgtttaaccgttacggtttacaacgtttacgaaacggttaaacgtttaaccctttaaccttttaacccctaaccgtaaaacgttcggtaacttacccgtaccccgttttacccgggaacccggtaaacggggtaacccgaaccgggtaacccggttaacgggggtaaaccgtttaaaacccggtaaaaccggg

SEQ ID NO: 170876 - DNA, 676 bp, Homo sapiens
  misc_feature: GYAE6OF01AXQ22.27.78.H01.1.454.CMB.1.raw
  modified_base (298)..(298): a, c, t, g, unknown or other
  misc_feature (298)..(298): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgacctacgaaaggagaaagtccaccatccaccgtcggccggcagtcagagtcgttggtagtagtcttacactcggtaaccanacagaacgccgaggtccagtccaccaaacgcctctacatacaagtactcgtccttccacgttcccttctcggtaccgggtcccctaggtacggttcgaggtcggatacggtcgtatcggtacgggacctacgtactttccgacccctacctaaccactaactacgtaaccgtccgtaacggaagtcttaaggagtagtactcgtacgacctaaacgtttattaaccgttacgtacctattaccgtaacgtaacgttaaccttaacccttttaacctaccgttaaggtacgttaacctaccgttcccggttaacccggtaaccgggaaccgtaacgggaaccctaaccggtaaggtaacgttaaagttaaaaacccggg

SEQ ID NO: 170877 - DNA, 757 bp, Homo sapiens
  misc_feature: GYAE6OF01CPJX2.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactaacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctggccggcagtcagagcgttggtagtagcttacactggtaccagcagaacgccgaggtcacgtctaccaaagctcctacatacaagtatcgtccttccctacgtccttccgtccggggggttcccctacggtacggttcaacggtggaccgtaggtcggtaacgtccgtaggggaacctaaccgttaacttttacccaaccccttacccaacctaacttaccgtaaaacttacgggacccgttaagggaaacgtccgttaaggaaagtacgttacgacccgttaggtaacccttaaaccttttaacgtttaaccgttacggtaacctaacgttaccgtaaacggttaacgtttaaccctttaaacccttttaacccgttaacgtaaaacggttaccgtaaacgttaccccgtaacccggtttacccgggaaacccggaaacggggtaacccaaaccggtaaccgttaacgggtaaaaggtaaaccgtttaaaaaccggtacgttaacggg

SEQ ID NO: 170878 - DNA, 827 bp, Homo sapiens
  misc_feature: GYAE6OF01BXZXA.27.78.H01.1.454.CMB.1.raw
tcagagcgtcgtctcacgaccggtgctcgatttagtgtgagtagtttgggttgggatgaaggcaaaacgtgacaaggtcgaaggcaggaagatgttgccataccacaactcgattgggttctgctgctctcggtccacgcctccaggggtagaattgtggcctggacctcagtcctcccagtacctttcagtcctcgtcgacctaccgaaaggacgaaacgtccaccatccacccgtcggacccggtcctacgtcgaaggtacggtaccggttaggtaagtaacgtccgttaacgtacgttcgggtaaacccagtacgaagtaacgccgtagggtaccaacgtacctaccgaaaagtcctacccgtaccaactacgaagttaattcgtccttacccgtagttcccgttacgtccggtaccgggtcccctagggttacgttacgaggtcggtacgtacggtacggtactcccgttagggaaacctacctttaactttaccccggaaacccccttaccgtaccctaaaccgttacgaaaaccgttcggtccccggttaaggtaccgtaccgtaagggtaacgtaaggttcggtaccgttaacgggttaaccctttaaacggttttacccgtttaaacttacggttacctaaaccgttaaccgtaacgttaacggtttaaaccctttacgtttaaacccgaccgttaaaggcctaacgttacctaaccggtttaccggacggtaaacgggaccgtacggaccgtaggaacgtaaacgttaaccgaaggttcggacgtacgcgtaacgactaccgttccgtgttcctaccg

SEQ ID NO: 170879 - DNA, 697 bp, Homo sapiens
  misc_feature: GYAE6OF01CXP8A.27.78.H01.1.454.CMB.1.raw
  modified_base (316)..(316): a, c, t, g, unknown or other
  misc_feature (316)..(316): n is a, c, g, or t
  modified_base (355)..(355): a, c, t, g, unknown or other
  misc_feature (355)..(355): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccagggtgaaattgtgctgactcagtctccagtactttcagtctgtgactaccaaaggagaaagtcacatcacctgccgggccagtcagagcgttaggtagtagacttacactggtaccagcagaacgcaggtcagtctaccaaagctcctcatcaagtatcgccttccctagtccttcncgtacgggtcccctgagttcgagtggctagtggactcgnggacacgtattccaaccctcacctactacaacgtacgaccgtaggaacgacgtaggaagatcgtacctaggtaccttaactttattaccgtgtacctaatactaacgggttaattaaccgttaaccgttttacctaactaacggttacgtaaccgttaccctaacccggtttaccggaaccgtaaaaccgggggtaacctaaaccggtaccggttaaacgggaaaccgggtttaaaacgttaaaaacccgggtaaccggttacgggttaaccgggttacccgttaacggtacccgttaacccttaaccggtttccgtttacccggttacccgttttaacccg

SEQ ID NO: 170880 - DNA, 575 bp, Homo sapiens
  misc_feature: GYAE6OF01DL2OP.27.78.H01.1.454.CMB.1.raw
  modified_base (470)..(470): a, c, t, g, unknown or other
  misc_feature (470)..(470): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtagactaccaaaggagaaagtcaccatcacctgccgggcagtcagagcgttggtagtagcttacacgtggtaaccagcaagaagccaggtcagtctaccaaagctcctcatacaagtatcgccttcccagtccttctcgacgggtcccctggagtcagtgctagtgctcgtaggacactacttccaccctcacctatacaatacgacgtaggaagcttaagaagtatcggactagtactaactttatacgttgactagtactaagtacttaacttacgtttaaccngtaagtcgtacttaccgtacccgttacggacgaaacgggaccacgacgtaggaagtaaacgttaaacgacgttggacggtctagacctaacnttnttcgtcttac

SEQ ID NO: 170881 - DNA, 680 bp, Homo sapiens
  misc_feature: GYAE6OF01A810L.27.78.H01.1.454.CMB.1.raw
  modified_base (246)..(246): a, c, t, g, unknown or other
  misc_feature (246)..(246): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacnctggtaccagcagagccaggtcagtctccaaagctcctcatcaagtactcgtccttcccacgttcccttcgtccgacggggtccccctcggacggttcgaggtcggcgtaggtcggaacgtcgaggggtacctactacgtttcccaaccctccaacctataacctaaatacgaccgtacggtaacgacgtaggtaacgatacgacgtacgtactaaaccgttaattaccttacgtactacgttacaacggtaattaacccgtttaaactttacccgttaacgtaaacggttacggtaacttacccgtaacccgtttacccgggacccggttaaaggggaaccctaaccggaaccgtaagggtaacgtaaacgttaaacgaaccgttaggtaccggtacgtcgtaacaccgtaattaccgtcgttccgtaacccg

SEQ ID NO: 170882 - DNA, 562 bp, Homo sapiens
  misc_feature: GYAE6OF01ELDZ6.27.78.H01.1.454.CMB.1.raw
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggatcttaaaagaggttctttctctgggatgtggcatgagcaaaaactgacaaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggagtagcttacactggtaccagcagaagccaggtcagtctaccaaagctcctcatcaagtatcgtccttcccacgttcccttcgtccacggggtccccctcggacggtttcaggtggcaggttcggattcgtggggacacgtacttttaccaccccgttacaccctaataccaaattacgccctagggaacgctagaagntgctgactaacttattactgttcatcagaagttactactttacctnaagtntatctaccttcggaccaaggcacgacgtggaacgagttaaaccg

SEQ ID NO: 170883 - DNA, 613 bp, Homo sapiens
  misc_feature: GYAE6OF01DFKRS.27.78.H01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaagganaagtcaccatcacctggccggccagtcagagtcgttggtagtagtcttacacgtcggtaccagcaagaagccaggtcagtactaccaagtcctcctacactacaagtatcgtcttccagtccttctcgacgggtccctcgacggttcagtcgcgaggtggtactcgtcgggacacgtatttacccacctacaccactacaacgtacgaccgtaggactcgtagaagatcgactgacctaacttacttactgtactatacgagtacgttaaccttacctttaacctacgaacgtttacgacttacccgttaacccggttacccgggaacccgtaaacgggacccgtaacggtacggtaacggtacgtaaacgttaaaacccggg

SEQ ID NO: 170884 - DNA, 604 bp, Homo sapiens
  misc_feature: GYAE6OF01D3M6O.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagcctcctcatcaagtatgccttcccagtccttctcgacgggtcccctgtaggttcagtggcagtggatcgtggacactactttccaccctcaccatacaatacgcctaggaagctagaagatgctagactaactttattacgtgtactatcgaagtacgttaccttacctttaaccctactaagttcgtacttaccgtacccgtttaccgggacccgtaaaggggacccaacggtacgtacgggtaacgtaaacgtttaaaaccggaacgttgggtacggtacctacggaccctaaccgtattaccgttcgtttccgtttacccg

SEQ ID NO: 170885 - DNA, 679 bp, Homo sapiens
  misc_feature: GYAE6OF01EQ4V9.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccgaaaggagaaagtcaccatccacctggccggcagtcagagtcgttggtagtagcttacacgtggtaccagcagaacgccaggtcacgtctaccaagctcctacatacaagtatcgtccttcccacgttcccttacgtccgtaccggggtcccctcggtacggttccgaaggttcggaccgtaggtggtactcggtcgggtaactacgtacgtttcccaccccttacgacctactacaaacgtacgaccgtaggaacgtcgtagaagagtcgcctagtaaccgttaacttacgttacttcgtactacgttacgaagtaaccgttacctttaaacccgtttacctaaccgtaacggtcgttaaccttaccgttaaccccggtttaccggtaaacccggtaaacgggtaacccgtaaccggtaacggtacgggtaaacgtaaacggtttaaaacccggg

SEQ ID NO: 170886 - DNA, 629 bp, Homo sapiens
  misc_feature: GYAE6OF01A0P4T.27.78.H01.1.454.CMB.1.raw
  modified_base (407)..(407): a, c, t, g, unknown or other
  misc_feature (407)..(407): n is a, c, g, or t
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaacgtcaccatcacctgccgggccagtcagagcgttggtatagcttacactggtaccagcagaagccaggtcagtctaccaagcctctcatcaagtatgacttcccatccttctcaccggggtcccctggacggttctagtcggctacggtgatcgtcgggactacgactttcgaacccctcaacccatacaaactagcctaggaacnctaggaagactgcctgactaaactttgttactgtcgtatccaagtacgttaaccttaacttttaccgactaaacgggtntaaaccgttcctaacgttacccgggtaccgaaaggggtaacccgacgttaaaccgttaggggaacggtaaaacttttaaaaccggaacgttcggttaacgggctttacggaccgtacctaagttaccgttcgttaacttaccg

SEQ ID NO: 170887 - DNA, 602 bp, Homo sapiens
  misc_feature: GYAE6OF01AS138.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgtaggttcaggtggcaggtggatcgtgggactactagtttccacccctacacccaatccaatacgccctaggaacgcgtagaacgaagtcgacgtggactaaacttattactcgtctactacaagtaacgttaccttacttttaccctacgtaaacgttcgtactacccgtaacccgtttaccgggacccgtaaacgggacctaacccggtaaccgtacgggtaagtaaacggttaaaacccgg

SEQ ID NO: 170888 - DNA, 741 bp, Homo sapiens
  misc_feature: GYAE6OF01D7JPT.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaaattgtgctgactcagtctccagtactttcagtctgtgactacgaaaggagaaagtcaccatccaccgtgccggaccagtcagagtcgttggtagtagcttacacgtggtaccagacagaacgccgaggtcacgtcctaccaaacgcctacctacactacaagtactcgtccttacccgtacgttccccttcgtccggtaccgggttcccctacggtacggttccgaaggtcggtacgtaggttcggtacgtccggtacgggtaccgtaccttaacctttacccgtaaccccttaccaacctaactaacctaacgtaccgtaccgtacggaacgtacgtaaggtaacgtacgtacggtactacgtaaccgttaaccgtttaacgttacgttacgttcctaaaaaacgttccgtaacgttaaccgttaaacctttaacctttaacccgtacgttaacggttaccgttacgttacccgttaacccggttacccgggtaacccggaaaccgggtaaccgtaacggtaaccggtaagggtaaaccggtaaacggttaaaacccgg

SEQ ID NO: 170889 - DNA, 771 bp, Homo sapiens
  misc_feature: GYAE6OF01CBUWO.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtgaaattgtgctgactcagtctccagactttcagtctgtgactaccgaaaggagaaagtcaccatccacctgccgggccagtcgagagtcgttggtagtagcttacacgtggtaccagacagacgcgaggtcagtactaccgaaacgcctcctacataccgaagttactcgtccttccctagttcccttcgtccgtaccgggtcccctaggtacggttcgaggttggacgtaggtggtacgtcgtacgggaacctactactttcccaccctaccaacctaactaccgtaacgttaaccgcccgttaaggaacgtaccgtagaaacgtagtcgtaccgtaacggtaccttaaacctttaagttaaccggttctaactaacgtacgtaacgttaaccgtttaacctttaacccgtttaaccctacgttaaacggttgttaaacccgttacccgtttaaccccgggtacccgggaaaccccggtaaacgggggaaccctaaccgggttaaaccggtaacggggtaaaccgttaaaacggttaaaaccggtacggtttaaccgggtaccgggttacccttaccgggaaccctttaaaccccgtatttcccggttaccggttttaaccc

SEQ ID NO: 170890 - DNA, 528 bp, Homo sapiens
  misc_feature: GYAE6OF01C0U31.27.78.H01.1.454.CMB.1.raw
  modified_base (436)..(436): a, c, t, g, unknown or other
  misc_feature (436)..(436): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagttccttctcacgggtcccctggaggttcagtggcaggtggatcgtgggacactactttccacccctcacccataccaaatcgcctggaacgctagaagntgctgactaacttattactgtcatcagtagttactacttacctnaagtnatcaccttcggaccaaggacaacgactggaagtagtaaaacgg

SEQ ID NO: 170891 - DNA, 561 bp, Homo sapiens
  misc_feature: GYAE6OF01CR0VC.27.78.H01.1.454.CMB.1.raw
  modified_base (296)..(296): a, c, t, g, unknown or other
  misc_feature (296)..(296): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggcagtcagagcgttggtagtagcttacacgtggtaccagcagaagccaggtcagtctaccaaagctcctcatcaagtntcgaccttcccagttcctctcgtacgggtcccctggagttcagtggcagtggatcgtggactactatttccaccctcacctataccaatcgctaggaagctagaanatgactgactaactttntactgtactatacgaagtacgttaccttacttacctactaagtctactctaccgtcggaacctaagggaccacggacgtagggaacgtaagttaaacgacgttcgtacggacttacgaacccgtactacgtcgttacgttcc

SEQ ID NO: 170892 - DNA, 518 bp, Homo sapiens
  misc_feature: GYAE6OF01A4EWN.27.78.H01.1.454.CMB.1.raw
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtcccttctcaggggtcccctcgaggttcagtggcagtgatctggacacatttcaccctcaccatcaatagcctggaanctgaagntgctagactaacttattactgtcatcaagatactactttacctacaagtgattccaccttcggaccaagggacacgactaggataacgttaaacgacttgacggctacggacacccattctgtcctac

SEQ ID NO: 170893 - DNA, 557 bp, Homo sapiens
  misc_feature: GYAE6OF01EEYUE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagttccttctcacggggtcccctcgaggttcagtggcaggtggatcgtgggacactactttccaccctcaccatcaatacgcctaggaagctgaagatgctgactaacttattactgtctatcaagtacgttacttactttacctactaagtcattcctaccgttccggaccgaagggaccacgtacgtaggaagtaaacgttaaacgaacgtggtacggtactacggtaccacctattccttggtccttaccg

SEQ ID NO: 170894 - DNA, 790 bp, Homo sapiens
  misc_feature: GYAE6OF01CKUYO.27.78.H01.1.454.CMB.1.raw
  modified_base (287)..(287): a, c, t, g, unknown or other
  misc_feature (287)..(287): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagacagaacgccaggtcagtctaccaaagctccncatacaagtatcgtccttcccacgttccttctccgtacggggttcccctacggtacggttcgacgtcggactaggtcggattcgtacgggacactactttccacccttcaacctattaccaaagttacgacccgtagggaacgtaccgttaggaaacgtagtacggtacctacggtaaccgttaaaaccttttaacgttaaccgtttacgggttacctaaaccgtttcccgtaaagggtttaaacggtttaaccccttttaaaccgtttttaacccctaaccggttaaaccggtttaaccggttaaacctttaccccgttaaaccccgttttaccggggaaccccgtaaaacgggggtaacccgtaacccgggttaaacggtaacggggttaaaaccgtaaaccgttttaaaaacccgggaaaccgttttcggggtaaccgggttaccgttaccggtaccctaaaccccgttacgttacctttcggtttccctttaaccccgg

SEQ ID NO: 170895 - DNA, 884 bp, Homo sapiens
  misc_feature: GYAE6OF01AFXLW.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagctttcagtctgtcgactaccgaaaggagaaacgtccaccatccaccgtcggcccggggacctaggtcaacggagtcgttgggtagtacgtcttacacgtcggtaccagcaggaacgtccaggtcagtcctaccgaaagcctccgtacatacgtaagtactcgtacctttcccgaacgttccctttacgtacccgtaccggggttaccccctacgggtaaggtttccgtaacggtcgggtaccgtacggttgggaactttccggttacggggaacctaccggttaacttttcccccgaacccccgtttacccgaaccccgtaacgttaaccgtaaacgtttaacccgggtacccgttacgggtaaacggtcccgttaagggtaacgtaaccggtagtacccgttaccggtaaccgtttaaaccttttaccgtttaaccgttcgggttaaccctaacggtttaaccgaacgggttaacccgttttaaaaccgttttaaccccgttttaacccgtaaacccgggtttaacgggttaacgtttaaccccgggtttaaccccgtttaacccccgggtttaaaccccgggtaaacccggttaaacccgggggttaaaacccgtaacccggttaaaccggggtttaacgggtaaaaccggtttaaaaccgggtttaaaaaacccggg

SEQ ID NO: 170896 - DNA, 586 bp, Homo sapiens
  misc_feature: GYAE6OF01BOE2D.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcacatcacctgccgggccagtcagagcgttggtagtagcttacactggtaccagcagaagccaggtcagtctccaaagctcctcatcaagtatgccttcccagtccttctcacgggtcccctcgagttcagtggcagtggatctgggacacgatttccaccctcaccatcaatacgcctggaagcgttagaaggattggactgactaacttacttactcgtcataccaagtacgttaaccttaacttttaccctataaacgttgtacttaccgtaccctttacggacccgaaagggaccaacgtaaccgtagggaacgtaaacgttaaacgaaaccgttggttacgggccttaggaccctaccgaattccgttgttccctttaccg

SEQ ID NO: 170897 - DNA, 625 bp, Homo sapiens
  misc_feature: GYAE6OF01DFDYD.27.78.H01.1.454.CMB.1.raw
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (569)..(569): a, c, t, g, unknown or other
  misc_feature (569)..(569): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattggtttctgctgctctgggttccagcctcgaggggtgaattgtgctgactcagtctccagtactttcagtctgtgactaccaaaaggagaaacgtcaccatccaccgtcggccggccagtcagagtcgttggtagtagtacttacacgtcggtaccagacaagagccgaggtcagtcctaccaaagtcctacctcaacttactaaagtactcgtacccttcccgtacgttcccttccgtacccggtacggggttcccccttacggtacgggtttccgaaggttcggacgtaaggtcgggtacttacggtacgggaactaccgtacttcccaaccctcacctactacaatacgcctaggaacgacagaanacgtnctgacctaattatactgtacactatacgtacttaacttaccttacgtatacgtntactcgtccttacggaccgaaaggacgtaacgagacggtaaagtaacgttaaacgg

SEQ ID NO: 170898 - DNA, 519 bp, Homo sapiens
  misc_feature: GYAE6OF01DIEEX.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagtccttctcgacgggtcccctcgaggttcagtggcagtggatctgggacacgtactttcaccctcaccatcaatagcctaggaagctagaagatgctagactaacttattactgtcatcagacgtacttacttacctctaagtgtatcaccttcggaccgaagggaccacgactggaagtaattaaacgagtgtggctgccacatctgtcttaccg

SEQ ID NO: 170899 - DNA, 552 bp, Homo sapiens
  misc_feature: GYAE6OF01DOC8I.27.78.H01.1.454.CMB.1.raw
  modified_base (300)..(300): a, c, t, g, unknown or other
  misc_feature (300)..(300): n is a, c, g, or t
tcagagcgtcgtctcacgaccggtgctcgatttagtgtgagtagtttggggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacacgtggtaccagcagaagccaggtcagtctccaaagctcctcatcaagtatncttcccagtccttctcgacgggtcccctcgaggttcagtgcgagtggatcgtgggacactatttccaccctcaccatacaattacgccgtaggaacgtctaggaagagtgacgtagtacctaactttatacgtgtcattcagtattaccttaactttacctagtaagtgtactctaccgttcggaccgaacggcacgtagtaggaacgtaattaaacggtactggtcgactcgaccactactcgtcgttccc

SEQ ID NO: 170900 - DNA, 516 bp, Homo sapiens
  misc_feature: GYAE6OF01BYUZX.27.78.H01.1.454.CMB.1.raw
  modified_base (447)..(447): a, c, t, g, unknown or other
  misc_feature (447)..(447): n is a, c, g, or t
  modified_base (508)..(508): a, c, t, g, unknown or other
  misc_feature (508)..(508): n is a, c, g, or t
tcagagcgtcgtctcacgaccggtgctcgatttagtgtgagtagtttgggtttggggatgagcaaaactgacaagtcaatgcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatcgtgggacactatttcaccctcaccatcaatacgcctggaagctagaagatgctgactaacttattactgtcatcagtattacttactttaccacaagtnactcaccgttcgaccaagggacacgacgtggaacgtaattaaacgactgtgctcgacaccntcgtgtcc

SEQ ID NO: 170901 - DNA, 574 bp, Homo sapiens
  misc_feature: GYAE6OF01DG85S.27.78.H01.1.454.CMB.1.raw
  modified_base (326)..(326): a, c, t, g, unknown or other
  misc_feature (326)..(326): n is a, c, g, or t
  modified_base (446)..(446): a, c, t, g, unknown or other
  misc_feature (446)..(446): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactaccaaaggagaaagtcaccatccacctgccgggcagtcagagcgttggtagtagcttacactgtaccagcagagccagtcagtctaccaaagctcctcatcaagtntcgtccttccctagttcccttcgtcgtaccggggttcccctcggtaggttcagtcggctaggtgatcgtagggactactacttccaccctcacctatacaatcgccgtagagctagaatntgctgtactaacttagttactgtacatcacgtacgttacttaccttaccactaagtcgtacttaccgtaccgttccggaacgaacgggactaccggtaacgtaggaaactaaagttaaaccgtaacgg

SEQ ID NO: 170902 - DNA, 607 bp, Homo sapiens
  misc_feature: GYAE6OF01A9VU1.27.78.H01.1.454.CMB.1.raw
  modified_base (280)..(280): a, c, t, g, unknown or other
  misc_feature (280)..(280): n is a, c, g, or t
  modified_base (425)..(425): a, c, t, g, unknown or other
  misc_feature (425)..(425): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatccaccgtgccgggccagtcagagcgttggtagtagcttacacgtcggtaccagcaagaagccaggtcagtcncaaacgctcctacatcaagtatgtccttccctacgttccttcctcgtacgggtcccctgtacggttcgaggtcgccgaggtggatcgtcgggacactacttccaccctaccaccatacaactacgacgtaggaacgacgtagaanacgtagcgtatactaaccttattacctagtcctagtctaagtacgttacttactttaccttacaagtcgtaaccttcctaaccgtttccggaaccgtaacggacctaacggtacgtacggaagtaacgtaaaccgtaacgttggtacggactacgtaccaacctagtccttgtccttacccg

SEQ ID NO: 170903 - DNA, 739 bp, Homo sapiens
  misc_feature: GYAE6OF01BVMEW.27.78.H01.1.454.CMB.1.raw
  modified_base (324)..(324): a, c, t, g, unknown or other
  misc_feature (324)..(324): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcaaagtctccagtactttcagtctgtgacctaccgaaaggaagaaacgtccaccatccaccgtcggccgggacctaggttagaggtcggttaggtagtacgtcttacacgtacggtaccgagaccaaggaacgccgaggtcagttcctaccaaacgccttccnctaactactaaaggtactcgtcccttaccctacgttccctttctccggtaaccggggttccccctcgggtacggtttcgaggtcggtacaggttggacgttcggtacggggaacctaacgtactttacccgacccttccgaacctacgtaccgtaaaacgttaccgaccggttaagggaacgtccgttaaggaaagtacgtacggtctacggtaactaaaccttttagtaacgttcgtactaacgtactaacggtaacgtttaccttaacccgttttaacaccgtaagtacgtacctaccgttaacccggttacggaccggtaacggtaccgacggtaccgtaaggacgtaaacgttaacggagttacggtcggaccgtcgaccgtacctacgttcttaccgttctacgttaccc

SEQ ID NO: 170904 - DNA, 595 bp, Homo sapiens
  misc_feature: GYAE6OF01D6GG7.27.78.H01.1.454.CMB.1.raw
  modified_base (349)..(349): a, c, t, g, unknown or other
  misc_feature (349)..(349): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgccttcccagtccttctcacgggtcccctcgtaggttcagtggcaggtggatcgngggacacgtactttccaccctccaaccatacaatacgcctaggaacgctagaagtactgctgactaatttacttactgtactatcgtaagtaacgttaaccttacttttacctacgtaagtagtacttacctacccgtttacggaccgaaacgggaccaacggtaccgtaggtaaacgtaaagttaaaaccgaacgttcggtacggtcctaacggtccaaccctagttccgttagttcttaacccg

SEQ ID NO: 170905 - DNA, 574 bp, Homo sapiens
  misc_feature: GYAE6OF01AX9VA.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtaacttactactgtaccagacagaacgaccgaggtcacgtactaccaaacgactcctacatactaagtatcgcctcctacgtccttcctcgacgggtcccgtcgtaggtcaggtggctaggtggatcgtgggacactacttccaccctcaccatacaactacgcgtaggaagtcctagaagtatcggtactaggacttaaacttattactgtacatacaagtactacttacctttacagaagtcatcctaccgttcggacgaaggacacgactggaaagtaattaaaccggattggtcgactacgacctaaccctagttcctcttccgtttcaaccg

SEQ ID NO: 170906 - DNA, 683 bp, Homo sapiens
  misc_feature: GYAE6OF01C3H55.27.78.H01.1.454.CMB.1.raw
  modified_base (226)..(226): a, c, t, g, unknown or other
  misc_feature (226)..(226): n is a, c, g, or t
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagngtcgttggtagtagcttacactggtaccagcagaacgccaggtcagtctccaaagctcctcatcaagtatcgcttcccacgtccttctccgacggggtcccctcggtaggttcagtcggcaggtggactcgtgggactacgtctttaccgacccctccaacctactactaacgtacgacccgttagggaacgtcgttagaacgtntacgcttacggtactaaacgtttacttacgttgtactattacaaggttacgttaacctttaccgtttaacccttacgtaacggttcgtaacttaccgttaacccgtttaccgggacccggtaaacgggtacccgtaaccgggtaccgtaagggaacggttaaaaccggttaaaccggttaaaccggttcgggttacggtacccgttcggaacccttaacctaacggtttccttccgtttcccgttaaccccg

SEQ ID NO: 170907 - DNA, 621 bp, Homo sapiens
  misc_feature: GYAE6OF01CKSUW.27.78.H01.1.454.CMB.1.raw
  modified_base (396)..(396): a, c, t, g, unknown or other
  misc_feature (396)..(396): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatcgtgggacactactttcaccctcaccatcaatagcctaggaagctgaagntgctgctaactttattactgtctatcaagtacgttaaccttacttttaaccctacgtaacgttcgtaacttacccgtaacccgtttaccgggacccgtaaacggggacctaaccggtaaccgtacggggtaaacgtaaacgtttaaaaccggaaaccgttgggttaccgggtacgttaccggtacctaaccccgtagtttcccttacggtttcccttttaacccg

SEQ ID NO: 170908 - DNA, 541 bp, Homo sapiens
  misc_feature: GYAE6OF01C22J5.27.78.H01.1.454.CMB.1.raw
  modified_base (180)..(180): a, c, t, g, unknown or other
  misc_feature (180)..(180): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
  modified_base (525)..(525): a, c, t, g, unknown or other
  misc_feature (525)..(525): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtgactaccaaaggagaaagtcaccatcactgccggcagtcagagcgttggtagtagtcttacacgtcggtaccaggcaagaagccagggtccagtctaccaaagcctcctcatacaaagtancgtcttccagtccttcncgacgggtcccctgagttcagtgcagtggatcgtggacactattccaccctcaacatacaatgaccgtaggaacnctagaagatgctagactaacttatacgtgtacatcaagtatacttacttacctataagtnactactaccgttccggaacgaacggacacggaanggaagtaaataaacgg

SEQ ID NO: 170909 - DNA, 544 bp, Homo sapiens
  misc_feature: GYAE6OF01AQIJO.27.78.H01.1.454.CMB.1.raw
  modified_base (319)..(319): a, c, t, g, unknown or other
  misc_feature (319)..(319): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctnatcaagtatgcttcccagtccttcgtcacggggtcccctcggtaggttcaggtcggctaggtggatcgtagggacacgtatttccaccctcaccctatcaaactacgcctaggaacgctagaagatgactgacaacttatactgtcatcagacgtactactttacctcaagtctatccacctttcggacctaaagggtaccacgatacggaagtaacttaaacgg

SEQ ID NO: 170910 - DNA, 613 bp, Homo sapiens
  misc_feature: GYAE6OF01D9PSN.27.78.H01.1.454.CMB.1.raw
  modified_base (145)..(145): a, c, t, g, unknown or other
  misc_feature (145)..(145): n is a, c, g, or t
  modified_base (503)..(503): a, c, t, g, unknown or other
  misc_feature (503)..(503): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtnaaattgtgctgactcagtctccagactttcagtctgtgactaccaaaaggagaaacgtcaccatccgacctgcccgggccagtcagagtcgttggtagtagcttacactggtaccagcagaagccaggtcagtctaccaacgtctcctcatcaagtatcgtccttcccacgttcccttctccgtaacggggttccccctaggtacggttcaggtcggacgtagtcggtactcgtcgggtaccacgtactttccgacccctacacctataccaaattcgccttaggaacgtcgtaagaacgtatcgcctagtactaactttagttactgtaccatccaagtacgttacttactttaccnaagtgtactcaccttcggaccgtaacgggacaccgtacgtagggtaaacgtaaactttaaacggacgttggcggtactacgtaccaaccttagtttctcgttcccttacc

SEQ ID NO: 170911 - DNA, 545 bp, Homo sapiens
  misc_feature: GYAE6OF01CX0UA.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccacgtccttctcgacggggtcccctcggtaggttcagtggcagtggatcgtggacactacttccaccctcaccatacaatacgcctaggaacgctagaagatgctagtactaacttattactgtacatcaagtacgtacttactttaccactaagtcgtactcctaccgttcggaccgtaagggaccacgacgtaggaagtaacgtaaacgactggtagtctagaccacatctgttcttaccg

SEQ ID NO: 170912 - DNA, 733 bp, Homo sapiens
  misc_feature: GYAE6OF01DVPW2.27.78.H01.1.454.CMB.1.raw
  modified_base (259)..(259): a, c, t, g, unknown or other
  misc_feature (259)..(259): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtcgactacgaaaggagaaagtcaccatccaccgtcggccggccagtcgagtaggtcgttaggtagtagtcttacncgtacggtaccagacgaggaacgccgtaggtcctacgtcctaccaaagtccttacctacgtactacgaagttactcgtcctttacccgtacggtttccctttccgtaccggtacccggggttccccttcggtacggttcgaacggttcggacgtacggttggacttacggtagggtaacctacttacgtttcccacccgtacacctatacaaacgtacgtaccgtaaggtaacgtacgttagaagtctacgtacgtcgtaactttaacgtttacttaccgttcgtacctaagtacgtaacggttacgttaacctttaacctttaccgtaagttaacgtcgtaaccttaccgttacccgttacggaaccgtaacggtaccgtacgtaaccgtagggtaaacgtaaccggttaaacgttaccggttggtaccggtcgttaccgaccgaccttaagttccgttacgtccgttacccg

SEQ ID NO: 170913 - DNA, 601 bp, Homo sapiens
  misc_feature: GYAE6OF01CO2HG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcctccaaagctcctcatcaagtatcgcttcccagtcccttctcgacggggtcccctggacggttcaggtggcaggtggactcgtagggacacgatttccaccctccaacccatcaaatacgacctaggaacgcgtagaagtatcgtactcgactaactttaacttactcgttacatctaagtaacgttaacctttaacctttaacctactaaacgttacgtaacttacctacccgttaccggaaccgtaaacggggtaccaacggtaacgtacgggaacgtaaacgttaaaaccgg

SEQ ID NO: 170914 - DNA, 524 bp, Homo sapiens
  misc_feature: GYAE6OF01BF46V.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacactactttcaccctcaccatcaatacgcctggaagctagaagatgctgactaacttattactgtcatcaagcttaacttactttacctactaagtgtatcctaccgttcggaccaagggaccacggactggaagtaattaacgaacgtgtcggctgccaccatcttgtcttac

SEQ ID NO: 170915 - DNA, 659 bp, Homo sapiens
  misc_feature: GYAE6OF01DX25E.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaaagtcaccatcacctgccgggccaagtcagagcgttggtagtagcttacacgtggtaccagcagaagccaggtcagtcaccaaagctcctcatacaagtatcgtccttcccagttcccttcgtcgtacggggttccccctacggtacgggttcaggtcggcaggtggtactcggtaggacactactttcccaccctcaccatacaactagccctaggaacgtctaaggaatatcgtactacgtactaactttattacttacgtactatacgtaagtacgttaaccgtttaccttaaccttacgtaacgttacgtaacttacccgtaacccggttccggaaccgtaacgggaccgtaaccggtaacggttaagggtaacgttaaaaccgttaaacggtaacggttacggttacggtaccgtacggtaacccaacctacgtttaccgtcggtttaaccc

SEQ ID NO: 170916 - DNA, 565 bp, Homo sapiens
  misc_feature: GYAE6OF01DBTVF.27.78.H01.1.454.CMB.1.raw
  modified_base (286)..(286): a, c, t, g, unknown or other
  misc_feature (286)..(286): n is a, c, g, or t
  modified_base (400)..(400): a, c, t, g, unknown or other
  misc_feature (400)..(400): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctccncatcaagtatgcttcccagtccttctcgacgggtcccctgtaggttcaggtggcagtggatcgtggacactatttccaccctcaccatacaatacgcctaggaacgctagaagntgctgacaactttatactgtcatcagtacgttaccttactttacctactaagtctactaccacccgtttacggaccgaaagggaccaacggacggtaggaaacgtaacttaaaccggtacttggacggtctacggacctaacctattccgttgttcctttacccg

SEQ ID NO: 170917 - DNA, 534 bp, Homo sapiens
  misc_feature: GYAE6OF01BUVEC.27.78.H01.1.454.CMB.1.raw
  modified_base (276)..(276): a, c, t, g, unknown or other
  misc_feature (276)..(276): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcnccaaagctcctcatcaagtatgccttcccagtccttctcgacgggtcccctcgaggttcaggtggcagtgatctgggacactatttccaccctcaaccatcaatacgcctggaagctagaagtatgctgactaactttattactgtacatcagattaactactttaccataagtcgtacttcaccgttacgaccgtaaacgggactacgacgtaggacgtaataacggaactggtagctaggccacactcgtgttacc

SEQ ID NO: 170918 - DNA, 596 bp, Homo sapiens
  misc_feature: GYAE6OF01DB0YE.27.78.H01.1.454.CMB.1.raw
  modified_base (150)..(150): a, c, t, g, unknown or other
  misc_feature (150)..(150): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaaattgtgctgactcagtctccagtactttcagtctgtgactaccgaaaaggagaaagtcaccatccacctggccggccagtcaggagtcgttggtagtgcttacactggaccagcagagccaggtcagtctacaagtctcctacatcaagtatcgtccttcccagttcccttctcgtacgggtccccctaggtacggttcgagtcggacaggtaggacgtcgtagggactacgtactttaccaccctccaactctaacaatacgaccgtagggaaactcgaagaagtatcgtactagaacttaacttagttactgtacatacagtactaacttacttacctanaagtcactccgaccgtacggtaccgaaggtaccaacggtagacggtaacgtaaagttaaccgaacgttcggaggtcctaggacccactaactgttacgttcc

SEQ ID NO: 170919 - DNA, 598 bp, Homo sapiens
  misc_feature: GYAE6OF01BNAEM.27.78.H01.1.454.CMB.1.raw
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtcctaccaaagctcctacatcaagtntcgtcttcccacgtccttcgtcgacgggtcccctcgtacgtcagtggcgngtggactcgtcggacnctactttcaccctcaccatacaaatacgtcctaggaancgtagaagtatgctagaacctaagtttaacttactgtacatacgacgtacttaccttaaccttactacctaaggtactactacctacccgttacggaccgtaacgggtacaccgtaccgtaggtaacgtaaaccgtttaaacggaacttggtacccggtattaccggaccaacccttaagttcccttaggttccttacc

SEQ ID NO: 170920 - DNA, 648 bp, Homo sapiens
  misc_feature: GYAE6OF01BQEBR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctaccaaagctctcatcaagtatgctcccagtccttctcgtacgggtcccctacgaggttcaggtggcgaggtggactcgtagggacacgacttttccaccccttacacccaatacaaatacgcccgttaggaacgccgtagaaggtactaggactaggactaaaacctttattaacgttacgtctatacacgtaagtaccttaacgtttaacctacgtaagtacgtaacgttccgttaacccgttaccgggaccgtaaaacgggaaccgtaaccgtaaccggtacgggtaaaggtaacgttaaaaccggtaaacgttcgggtaacggtaccgtacgtacccgtaacctaccgttaccttaggttaccctttacccg

SEQ ID NO: 170921 - DNA, 586 bp, Homo sapiens
  misc_feature: GYAE6OF01ADBN9.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctaccaaagcctcctcatacaagtatcgcttcccacgttccttccgtcgacggggttcccctcggtacggttcacggtgcgtaggtggatcgtacgggacctactactttccaccctccaccctatacaatacgccgtaggaacgctagaagctgcctagtacctaatttacgtacttgtacagtacagtaacttaccttactttaccctagtaagtcactccgtaccgttccgggaacgtaacgggacctaacggtacgtaacggagtaagttaaacccgg

SEQ ID NO: 170922 - DNA, 555 bp, Homo sapiens
  misc_feature: GYAE6OF01EA95O.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccggccagtcagagcgttggtagtagcttacactggtaccagcagaagccaggtcagtctccaaagctcctcatcaagtatgccttcccagtcccttctccgacgggtcccctgacggttcaggtgcaggtgatcgtggactactattccaccctcaccatcaatacgcctggaagctagaagtatgactgactaacttattactgtacatacagtacgtacttactttacctacgtaagtcgtactcctacccgttaccgggaccgaaacgggaccaacgtacgtaggtaacgtaagttaaaaccgg

SEQ ID NO: 170923 - DNA, 688 bp, Homo sapiens
  misc_feature: GYAE6OF01DLZ52.27.78.H01.1.454.CMB.1.raw
  modified_base (278)..(278): a, c, t, g, unknown or other
  misc_feature (278)..(278): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacnctggtaccagcagaagccaggtcagtctaccaaacgctcctcactacaagtatcgcttcccacgtccttctcgacgggtcccctcgtacggttcaggtcggcgacggtggacgtcgtggggacctacgtactttccaccctacgacccataccaattacgcccgtaggaacgtctagggaaacgtagtcgacttacgtaccgtaaaacctttttagtttaaccgttacggttcctaacgttacccgtagttaaaccggtttaaccctttaaacccgttttaaccccttaccgttaaacgttacgtaaccgtttacccgtaaccccggtttacccggaaccccggtaaaacccgggggtacctaaacccggaccggtaaacgggtaacgtaaacggtttaaaaaccccggg

SEQ ID NO: 170924 - DNA, 647 bp, Homo sapiens
  misc_feature: GYAE6OF01CBIAV.27.78.H01.1.454.CMB.1.raw
  modified_base (193)..(193): a, c, t, g, unknown or other
  misc_feature (193)..(193): n is a, c, g, or t
  modified_base (277)..(277): a, c, t, g, unknown or other
  misc_feature (277)..(277): n is a, c, g, or t
  modified_base (337)..(337): a, c, t, g, unknown or other
  misc_feature (337)..(337): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctcaggggtgaaatgtgctgactcagtctccagtactttcagtctgtgactcaaagganaagtcacatcactgccggcagtcagagcgttggtatagtcttacacgtggtaccagcagaagcagtcagtctcaaagcctcctnatcaagtatcgcttccacgtcctactcgacgggtcccctgtacgtcagtgcagtgatcgnggacacactttcaaccctcgacctaatacaaatacggcctaggaagtctaggtaacgtagtacgctaggtaacctaaacgttacttaccgtaggttactaacgtaccgtaagttacggttaaacccttaacgttttaacccgtaaccgttaaaggttacgtaaccgttaccgttaacccgttacccgggtaacccgaaaacggggtacctaaaccggtaacggtaccgggaaagttaaaccggttaaaccggtaacggttacggtacggttccacggtacctacctacttacgttcgtaccctttacccg

SEQ ID NO: 170925 - DNA, 646 bp, Homo sapiens
  misc_feature: GYAE6OF01AB29P.27.78.H01.1.454.CMB.1.raw
  modified_base (225)..(225): a, c, t, g, unknown or other
  misc_feature (225)..(225): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattggtttctgctgctctggttccagcctcagggtgaaattgtgctgactcagtctccagactttcagtctgtcgactccaaaggnaaagtcaccatcacctgccggcagtcagagtcgttggtagtagtcttacactggtaccagcagaagccaggtcagtctaccaaagcctcctacatcaagtatcgccttccagttccttcgtcgacgggtcccctgtacggttcagtgacgaggtcgatcgtagggacacgtactttaccacccttacgaccctatacaaagtacgacccgttggaaacgcgttacgaacggtattcgacttacggaccttaaccttattaacgtacgtactacgtaccgtaaggtaaccgttaccttaaccgttttaccctacgtaaacggttcgtacgttacccttacccggttacccgggtaaccccgaaacggggtacccttaaccggtacccgttaacgggtaaacgtaaccgtttaaaaacccggg

SEQ ID NO: 170926 - DNA, 503 bp, Homo sapiens
  misc_feature: GYAE6OF01EZCFM.27.78.H01.1.454.CMB.1.raw
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatgaacaaaactgacaagtcaaggcaggaagatgttgccatcacaactcattgggtttctgctgctctgggttccagcctccaggggtgaaattgtgctgactcagtctccagacttttcagtctgtgactccaaaaggagaaagtcaccatcacctgccgggccagtcagagcgttggtagtagcttacactggtaccagcagaagccaggtcagtctccaaagctcctcatcaagtatgcttccagtcctctcaggggtcccctcgaggttcagtggcagtggatctgggacacatttccaccctcaccatcaatagcctggaanctgaagntgctgcaacttatactgtcatcagtagtactacttaccncaagtgatcaccttcggaccaagggccagactggagtattaaacgactgtggctgacctacatctgtcttgac

SEQ ID NO: 170927 - DNA, 763 bp, Homo sapiens
  misc_feature: GYAE6OF01EUQCK.27.78.H01.1.454.CMB.1.raw
  modified_base (320)..(320): a, c, t, g, unknown or other
  misc_feature (320)..(320): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagtactttcagtctgtgactccaaaggagaaagtcaccatcacctgccggcagtcagagcgttggtatagcttacactggtaccagcagaacgccaggtcacgtctaccaaagcctcctnactactaagtatcgtccttacccgagttcccttcgtccggtaccggggttccccctacggtacgggtttcacgggtcgggactacgggtaggtaacgttccggtacggggaactaccgttaactttacccgaacccccttaccaaccctaactaccgtaaacgttacgtacccgtaagggaacgtacccgttaaggtaacgtagttcggtacctacgtaaccgttaaaacttttacgtttaaccgttacggttaacctaacgttacgtaaacggttaacgttttaaacccttaaacccgtttttaacccgtacgttaaaacggttcgttaaaccttacccccgtaacccggtttaacccgggtaacccgggaaaaccgggttacccgaaaccgggttaacccggtaacggggttaaaaccggtaaacgtttaaaaaacccggg

SEQ ID NO: 170928 - DNA, 709 bp, Homo sapiens
  misc_feature: GYAE6OF01C9SHA.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatccacctgccgggcagtcagagcgttggtagtagtcttacactggtaaccagcagaacgccaggtcagtcctaccaaaggccttaccctacactacgaacgtacttcggtccttccccgtacgttccctttccgttacccggaccgggggttcccccttcggtaacgggtttccgtaaggttcgggacctaggtggtaacgtcggttacggggaacctaacgtaccttttcccgaaccccttaccaaccctactactaaactcgtaccgtaggaacgtccgtagaacgtctgccttgaccttaactttattacttaggtactaacttcgaacgttacgttaaaccctttacgtttacccgtactaaacggttcgtaagtttaccccggtacccgttttaccgggaaccccgtaacgggtaaccgaaacccggttacgtaacggtaaaggtaaccgtttaaaaacccggg

SEQ ID NO: 170929 - DNA, 624 bp, Homo sapiens
  misc_feature: GYAE6OF01COTD1.27.78.H01.1.454.CMB.1.raw
  modified_base (200)..(200): a, c, t, g, unknown or other
  misc_feature (200)..(200): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaagganaaagtcaccatcacctgccggccagtcagagcgttggtagtagcttacacgtggtaccagcagaagccaggtcagtctaccaaagcctcctcatacaagtatcgccttcccagttcccttctcgtaccgggttcccctcggtaggttcaggtcggcgaggtggtacgtcgtgggacctactactttaccctaccctcaacctataccaatacgtccgtaggaacgtctaagaagtatcgtactagtaccttaactttacttacttcgtactaactcgtaacgttaagttaacctttaacctttaccgtagtaacgtgtaacttacctaaccgttccgaaccggacgggacctaacggacgtacggtacgtaagttaaaccggtaacgtggtcggactacgacctaccgtaattccgtcgttacc

SEQ ID NO: 170930 - DNA, 569 bp, Homo sapiens
  misc_feature: GYAE6OF01A1ZV5.27.78.H01.1.454.CMB.1.raw
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgccttcccagtccttctcgacggggtcccctcggaggttcagtggcaggtggatcgtggggacacgtactttcaccccttcaccctatacaatacgccctagggaancgtagaacgatgctanaccgtaacttattactgtcatcagtagttacctactttacctacgtaagtgactcctacccgttacggacccgtaaacgggaccacgaacgtacgggtaagaagtttaaaacccgg

SEQ ID NO: 170931 - DNA, 745 bp, Homo sapiens
  misc_feature: GYAE6OF01BS5YE.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgagggtgaattgtgctgactcagtctccagtactttcagtctgtgactacgaaaggagaagtcacatcaccgtgccggacagtcagagtcgttaggtagtagtacttacacgtggtaccagacaagacgccgaggtcagtactacgaacgtcctctacatacgaagtactcgtccttaccacgttcctaccgtcggtaccgggtccctacggtacggttcgacggtcgacgtaggaggtacgtcgtacggacctacgttacttcccgaaccctcaaccgtactaccgtaagtaccgtaccgtaggaaacgtccgtaaggaacgttagtcgtacctacggttaaacttaacgtttacttaaccgttacgtaacacgttacgtaacgggttaacctttaacccgtttaaccgttttaaccgtaagtaaacggtttaccgttaaaccgttcccggttaacccgttaccgggtaaacccggtaaacggggacccttaaacgggttacccggtaaggttaaaccgttaaacgtttaaacggtaacgtttcggtaacgggtacccgttaacgaccccgttaacgtacgtttccggtaccgttttaccccg

SEQ ID NO: 170932 - DNA, 565 bp, Homo sapiens
  misc_feature: GYAE6OF01CUW5A.27.78.H01.1.454.CMB.1.raw
  modified_base (470)..(470): a, c, t, g, unknown or other
  misc_feature (470)..(470): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctacaaagctctcatcaagtatgctccagttcctctcgacgggtcccctgaggttcagtggctaggtggatcgtagggactacgtatttccaccctcaaccgtactacaatacgccgtaggaacgtctagaaagattcgactacgactaactttattactgtacatcaagtacgttacttacttacctactaagtnactctaccgttcggaccgaagggaccacggtaactacgggaataacgttaaacgacgttagggtacgcgtacggaccaccgtatccgtgttaccc

SEQ ID NO: 170933 - DNA, 601 bp, Homo sapiens
  misc_feature: GYAE6OF01DQG7P.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccacctcggcccgggccagtcaggagtcggttggtagtagcttacacgtggtaccagcaggaacgccgaggtcagtctaccaaagcctcctcatacaagtatgtccttcccacgttccttctaccggaccggggttccccctcggtacggttcaggtggcgtaggtcggactcggtacgggaactacgtactttccaccctacacctatacaatacgccgtaggacgcgtagaagtatcgctacgactaactttatactgtctatcagtacttacttacctttacctagtagtcacttacctaccgttccggacgaacggtaccacggtacgtaggaacgtaacgtaacgtacgtgtacggactacgaccacgtactccgttgtccc

SEQ ID NO: 170934 - DNA, 570 bp, Homo sapiens
  misc_feature: GYAE6OF01CI223.27.78.H01.1.454.CMB.1.raw
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccgggccagtcagagcgttggtagtagtcttacactggtaccagcagaacgccaggtcagtctaccaaagctcctcatacaagtatcgtccttcccagttcccttcgtccgacggggttccccctcggtacggttcaggtcggcgtaggtggtactcgtaggggactacatttccaccctccacctatacaatacgccgtaggaagcgtgaagntcgctgactaacttattactgtacatacagtacgttactaccttactactaagtctatcctaccgttcggacccgtaagggaccacgacgtaggagtaacgttaaacgg

SEQ ID NO: 170935 - DNA, 588 bp, Homo sapiens
  misc_feature: GYAE6OF01EOY67.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacacgtggtaccagcagaagccaggtcagtctccaaagctcctcatcaagtatgtccttcccagttcccttctcgtacggggtcccctcgtaggttcaggtggctaggtggatcgtgggactactactttccaccctcacctatcaagtacgcctaggaacgtcgtagaagagtcgctagacctaacttattactgtacatcaagtatactttacttaacctactaagtcgtaacttccgtaccgttcggaccgaagggaacctacggtacgtaggtaacgtaaacgttaaaaccggacgtaggtacggccgtacgtacctaccgtattccgttcgttccttaccg

SEQ ID NO: 170936 - DNA, 584 bp, Homo sapiens
  misc_feature: GYAE6OF01CSRJ0.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgctttcccagtccttctcagggtcccctgacggttcagtggcagtggatctgggacacgatttcaccctnacccatccaagtgcctggaacgtctagaagatgctgctaacttnttactgtacatccagtacgttacctacttttaaccnctaacggtcgtattcctaccgttcgggaccctaaggggtacctaccggtaactcgggtaacggtaacgtttaaaccggaaccgttcgttggggtacccttcggtaccgtacccgtaagttccgttcggttcgttacccg

SEQ ID NO: 170937 - DNA, 849 bp, Homo sapiens
  misc_feature: GYAE6OF01E3PDD.27.78.H01.1.454.CMB.1.raw
tcagagcgtcgtctcacgaccggtgctcgatttagtgtgagtagtttgggtttgggggtaggtgaggcaaaacgtgacaacgtcaacggtcgaggtaacgatgttgcctactcacgaactcagttgggtttaccttgacttagactcgtcgggttccaacgccttccggaggggtttggaaattggtggccttgggttaccttcgtagtccttaccgttaaaggtactttccagtctgtgactccgaaaggacgtaaaggtcgaaccgtacggtacgaccgttggcccgggaccgacggggtccaggaacgtccggtttcggtaagttacgcgttaccgacgtcggttaccagactaacgaacgtaccgtacggtacgtacgtaccgtaccgaaacgtccttacctacgtacgtaccgtaacgttacgtccgtacccgttacccggtaacggttcccgttaccggtaccggtaccgggttccccgttcggtaccggttacgtaacggtacggtaaccgtacggtacggtaacgttaccggtacggtaacctaacttacttaccgtacccgtaccgtaccgtacgtacgtaacgtacggtaccgtacggtaacgtacgtaacgtaacgtacgtacggtacgtagtaacttaacgttaacgttacgtacgtacgtaacgtacgtaacgttacgttaaccgttaacctttaacgtaacgtaacgtacgtaacctaaccgtaaccggtaccggaccgaaccggtacgtacgtaacgtacggtaacgtaaaccgtaacgacggtacggtaccgtaccgtacgttaccgttacttagtttcgtcgttcgttaccg

SEQ ID NO: 170938 - DNA, 578 bp, Homo sapiens
  misc_feature: GYAE6OF01AZTIJ.27.78.H01.1.454.CMB.1.raw
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccagtcagtctacaagctcctnatcaagtatgcttccagtccttctcacgggtccctcgaggttcagtggcagtcggatcgnggacactactttccacccctcaccatacaatacgccctagggaacnctagaacgagtgccttagacctaactttacttaccgtgtactatacgaagtacgtacctttaccttttacccacgtaacgttcgaacttccgtaacccgtttcggacccgtaaaggggtacccaaccggactagggaacgtaaacgttaaaaccgg

SEQ ID NO: 170939 - DNA, 576 bp, Homo sapiens
  misc_feature: GYAE6OF01AI7FT.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagttccttctcgacggggtcccctggacggttcagtggcaggtggatcgtgggactacatttccaccctcaccatacaatacgccctaggaacgctagaagatgctgactaacttatactgtcatcagtacgttacttactttaccctagtaagttcgtaattacccgtaccgtttacccgggaacccgaaacggggtaacccaacggtaacgttacgggaaagtaaacgttaaaaaccgg

SEQ ID NO: 170940 - DNA, 693 bp, Homo sapiens
  misc_feature: GYAE6OF01CI1P2.27.78.H01.1.454.CMB.1.raw
  modified_base (330)..(330): a, c, t, g, unknown or other
  misc_feature (330)..(330): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcaccgtgccgggccagtcagagcgttggtagtagcttacactggtaccagcagaagccaggtcagtctccaaagcctcctcatcaaattntcgcttcccattcccttctcgaccggggttcccctcgtacggttcaggtcggcaggtcggatcgtgggactactactttcccaccctccaccataccaatacgccgtaggaagccgtagaacgtatcgtacttacggtaccttaaacgtttactttaaccgttcgttaccgtaacttacgtaacggttaaccgtttaaccttttaacccgttttaacccttaaccgttaaacgggtttacgtaaaccgtttaccccgttaaccccggttttaccccggggaaaccccgttaaacgggggtaacccctaaacccgggtaaccggtttaacggggaaaacgttaaacccggtttaaaaacccggg

SEQ ID NO: 170941 - DNA, 534 bp, Homo sapiens
  misc_feature: GYAE6OF01BQNEV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcagggtctctcgagtcagtggcagtggatcgtgggacactatttcaccctcaccatacaatacgcctaggaagcgtagaagatgctgactaactttattactgtcatcaagacgttaacttactttacctactaagttacgacttcaccgttacggaccgaagggaccacgactcggaagtaagtaaacgtaacgtgtacggacgtagacactatcgtgttacc

SEQ ID NO: 170942 - DNA, 702 bp, Homo sapiens
  misc_feature: GYAE6OF01B0NKH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccgaggggtgaaattgtgctgactcagtctccagtactttcagtctgtgactaccgaaaggagaagtcaccatccacctgccgggcagtcacgagtcgttggtagtagtcttacactcggtaccagcgagacgaccgaggtaccagtacctaccgaagtcctccgtactatacaagttactcgtacctttacccacgttcccttaccgtccggtacccggggttccccctcggtacggttccgacggttcggacgtacgggttaggtacgttcggtacgggaccttaaccgttactttaccccgaacccctaccctaactaacttaaccgtaacgttaccggaccgtacgggtaaccgtacgtaacgtaagtatccgtactacgtaactaacttttacttacgtacgttactacgtagtaacgtacgtaaccttacttacctagtaattcgtacttaccgtacccgttaccgggaccgtaaacggtaccgtaaccggtacggtaaggaaacttaaaccgttaaacggtacgg

SEQ ID NO: 170943 - DNA, 559 bp, Homo sapiens
  misc_feature: GYAE6OF01B1YEN.27.78.H01.1.454.CMB.1.raw
  modified_base (146)..(146): a, c, t, g, unknown or other
  misc_feature (146)..(146): n is a, c, g, or t
  modified_base (198)..(198): a, c, t, g, unknown or other
  misc_feature (198)..(198): n is a, c, g, or t
  modified_base (439)..(439): a, c, t, g, unknown or other
  misc_feature (439)..(439): n is a, c, g, or t
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgacctccaaaggganaaagtcaccatcacctgccgggccagtcagagcggttggtagtacgctttaacacgttcggtaccagcagaaagccaggtcagtctccaaagctacctcatacaagtatgccttcccagttcccttctccgacggggttcccctcggtacggttcgaggttggccgtagtcggatcgtacgggacactacttcgacccttcacctatcaaatacgcctacggagcgtagaagagtgcgtanactaacttattactgtctatcaagtactacttacttactacaagtntactacctacgtcgacgaaggccaacgcgtaggagtactaaacgacgtcgtagactgacactatctgtcgttac

SEQ ID NO: 170944 - DNA, 664 bp, Homo sapiens
  misc_feature: GYAE6OF01CB6MK.27.78.H01.1.454.CMB.1.raw
tcagagcgtcgtctcacgaccggtgctcgatttagtgtgagtagtttgggtttggggatgagcaaaactgacaagtcaaggcaggaagatgtgccatcacaactcattgggtttctgctgctctgggttccagcctccgaggggtgaaattgtgctgactcagtctccagtactttcagtctgtgactacaaaggagaaagtcaccatccactggccggccagtcagagtcgttggtagtagcttacacgtggtaccagcagaagccaggtcagtctccaaagctcctcatcaagtatcgccttcccagttccttctccgtacgggtcccctggtacggttcaggtggcaggtcggatcgtcgggactacgtactttccaaccctcaacctatacaaatacgccgtaggaacgtcgtagaagtagtcgctacggtacttaaacttacttacgttcgtacgtaatacgtaacgtaacgtttaacccttaacttttaaccgtacgtaacggttacgtaacccttaccgtaacccgtttccgggaaccgtaaacgggacccgtaaccggtaacgtagggtaaacgtaaaaccttaaacgggaacgtttacgggacggttacctacgggtaaccctacttaaccgttcttcggttacctttaccccgg

SEQ ID NO: 170945 - DNA, 667 bp, Homo sapiens
  misc_feature: GYAE6OF01B2N9P.27.78.H01.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactccgaaaagganaaagtcacatcactgccggccagtcagagcgttggtagtagcttaacactggtaccagcagaacgccaaggtcagtctaccaaagctacctnaatcaagtatgccttcccgagttcccttctccgtacggggttcccctacggtaggttcaaggtcggactaggtggtaactggtacgggaacctacttaacgtttcccaaccccttcgtaacccctaagttaccaaacgttacggccccgtaagggaacgtccgttaggaaagtcttacggccttacggtaaccttaaccgtttaacgtttaccttacggttacctacgttacaacggtaacttaacccgtttaacttaccgtactaacgtcgtattaccccgtaccgttaccggacccgaaacgggtaccaccggaaggtcggaaacgtaacgttaaaaccgg

SEQ ID NO: 170946 - DNA, 513 bp, Homo sapiens
  misc_feature: GYAE6OF01BH2IR.27.78.H01.1.454.CMB.1.raw
  modified_base (505)..(505): a, c, t, g, unknown or other
  misc_feature (505)..(505): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcagtggcagtggatcgtgggacactatttccaccctcaccatcaatacgcctggagctagaagatgctgactaacttattactgtcatcagtagtactactttacctctaagtgatccaccttcggaccagggacacgactggacgtattaaacgactgtgactgacacntctgttcc

SEQ ID NO: 170947 - DNA, 534 bp, Homo sapiens
  misc_feature: GYAE6OF01BZI1V.27.78.H01.1.454.CMB.1.raw
  modified_base (440)..(440): a, c, t, g, unknown or other
  misc_feature (440)..(440): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtggacacgatttccaccctcaccatcaatacgccgtaggaagctagaagatgctgactaactttatactgtcatcagtatactactttacctanaagtgatcctaccttcggaccaagggaccacgacgtaggaagtaacttaaacgacgtggtacggctcggaccacctattccttgttccttaccg

SEQ ID NO: 170948 - DNA, 619 bp, Homo sapiens
  misc_feature: GYAE6OF01EKOAW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctcaaagctcctcatcaagtatgccttccagtccttctcgacgggtcccctgaggttcagtggcagtggatcgtggacactatttccaccctcacctatacaatacgccttaggaagtctagaagattgactgactaactttacttactgtacatcaagtaacgttaccttaactttacctactaaagtcgtaacttccgtaacccgttccgggaacccgtaaacggggaaccctaacgggtaaccgttaagggaaacgttaaacggtttaaaaaccggaacgttgggtaaccgggtacccgttacggaccctaacccgtaatttaccgttcgttcctttaacccg

SEQ ID NO: 170949 - DNA, 835 bp, Homo sapiens
  misc_feature: GYAE6OF01BOE0H.27.78.H01.1.454.CMB.1.raw
  modified_base (192)..(192): a, c, t, g, unknown or other
  misc_feature (192)..(192): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcagggtgaattgtgctgactcagtctccagactttcagtctgtgactcaaagganaaagtcacatcacctgccggccagtcagagcgttggtagtagcttacactggtacagcagagccaggtcagtctaccaagcctacctcactacgaagtactcgtccttacccgacgttcccttcgtccggtaccggggttcccctacggtacgggtttcgacggttcgggaccgtaaggtcgggtacttacgggtcggggaaccttaaccgttaacgttttacccaaccccgtacctaacccgtaacttaccgtaaaagttacccggacccggttagggaaaccggtccgtttaagggaaagtacgttacggtacgttaacggtaaccctttaaaaccgttttaacgtttaacccgtttacggttaaccctaagtttaaccgtaaacggtttaacgtttaaacccttttaacccgttttaacccgtaaacgttaaacggttacgtaacccgttaacccgttaaccccggtttacccgggaaacccggttaaaacggggacccttaaaccggggtaaaccgttaacggggtaaacggttaaaaaccgtttaaaaccgggaacccttttaacgggggaccgttaccgtaccgggtaacccctaacccgttaagtttcccgttaacggtttcctttaacccccggg

SEQ ID NO: 170950 - DNA, 541 bp, Homo sapiens
  misc_feature: GYAE6OF01DG83M.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgcttcccagttccttctcgacgggtcccctcgagtcagtggcagtgatcgtgggacacatttccacctcacatacaatacgcctaggaacgctagaagatcgctagactaacttattactgtacatcagtagttacttaaccgtttacctactaagtgacttctaccgttcggaccgaacggtaccacggacgtagggaaagtattaaacgacgtggtacgctgaccacctatcctgttcc

SEQ ID NO: 170951 - DNA, 522 bp, Homo sapiens
  misc_feature: GYAE6OF01BEDW7.27.78.H01.1.454.CMB.1.raw
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcggaggttcagtggcagtggatctgggacactatttccaccctcaccatcaatagcctggaanctagaagatgctgactaacttattactntacatcagtacttactactttacctacaagtgaattcctaccttccggaccaagggccaacgactaggagtaattaaacgacgtgtacgctgacacatctgtctac

SEQ ID NO: 170952 - DNA, 558 bp, Homo sapiens
  misc_feature: GYAE6OF01EPRBB.27.78.H01.1.454.CMB.1.raw
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (548)..(548): a, c, t, g, unknown or other
  misc_feature (548)..(548): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatcgtccttcccagtccctttctccgacggggtcccctcggaggttcaggtggcgaggtggatcgtgggacactactttccaccctcacatccaatacgcctgggaacncgtagaagntgctagacctaactttattactgtcatcaagtacttacttacctttacacgtaagtgtactctaccgttcggaccgaagggaccacgacgtaggagtaacttaaacggacgtggtagtcgtacgacactntcgtgttacc

SEQ ID NO: 170953 - DNA, 699 bp, Homo sapiens
  misc_feature: GYAE6OF01B6YSP.27.78.H01.1.454.CMB.1.raw
tcagagcgtcgtctcacgaccggtgctcgatttagtgtgagtagtttgggtttggggagtgagcaaaactgacaagtcaaggcaggaacgatgttgccatcacaactcattgggtttctgctgctctgggttccagcctccgagggtgaaattgtgctgtactcacgtcctccagactttcagtctgtgactaccgaaaggagaaacgtccaccaatcaccgtgccgggccagtcgagagcgttggtagtagcttacactaggtaccagccaagacgccaggtctagtactaccaaagcctcctacatacaagttactcgccttccctacgttcccttcgtccgtaccgggtcccctcggtaggtcaggtggacgagtcgagtcgtacggactactacgtttccaccctacaccgatacgaaactagtaccgtaggaacgcgtaagaagtacgtcgactacgaacttaacgtttagttacgttcgtaacgtacgttaccgtaaaggtacgtttaacctttaaccgttttacccgtaacgtaagttccggtaacttacccgtaacccggtttaccgggaaccgtaaacgggggtaaccctaaccggtacgttaacggaaacgttaaccgttaaaaccggtaaccgttcggtaacggtcctaacggtaccctaaccgtagttccttaggttcccttaccgg

SEQ ID NO: 170954 - DNA, 598 bp, Homo sapiens
  misc_feature: GYAE6OF01EA0PK.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcagggtgaaattgtgctgactcagtctccagactttcagtctgtgactccaaaaggagaaagtcaccatcacctgccggccagtcagagcgttggtagtagcttacactggtaccagcagaagccaggtcagtctccaaagctcctcatcaagtatgcttcccagtcccttctcacgggtcccctgacgttcagtggcagtgatcgtgggacacgtactttcacccgtcaaccgataccaatacgccgtagggaacgacctaggaaacgtatcggactgacctaactttattactgtacacttcgaagtacgtacttaaccgtttacctacgtaaacgttgacttcctaaccgttccggaccgtaacggggaaccaaccggtaacgtacgggtaaacgtaagttaaaaccgtaacgttacggtcggacttacgaccctaaccgtacttcctggttaccc

SEQ ID NO: 170955 - DNA, 510 bp, Homo sapiens
  misc_feature: GYAE6OF01AUQIU.27.78.H01.1.454.CMB.1.raw
  modified_base (228)..(228): a, c, t, g, unknown or other
  misc_feature (228)..(228): n is a, c, g, or t
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggcagtcagagcgttggtagtagcttacactggtaccagcagaagccaggtcagtctccaaagctcctcatcaagtatgcttcccagtccttctcaggggtcccctcgaggttcagtgcagtggatcgtgggacacatttcaccctcacccatcaatagacctggaanctagacgatgctgcaacttattactgtcatcagtagtactactttacctnaagtgatctaccttcggcaaggacncgaactggagattaaaccgg

SEQ ID NO: 170956 - DNA, 533 bp, Homo sapiens
  misc_feature: GYAE6OF01B2MC7.27.78.H01.1.454.CMB.1.raw
  modified_base (458)..(458): a, c, t, g, unknown or other
  misc_feature (458)..(458): n is a, c, g, or t
  modified_base (529)..(529): a, c, t, g, unknown or other
  misc_feature (529)..(529): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtcccttctcacggggtcccctcggaggttcaggtcggcagtggatcgtgggacactatttcaccctcaccactcaattacgcctaggaacgctagaaagtatgctgactaactttattactgtacatcgagtattaactactttacctntaagtgtactcctaccttcggaccaagggccacgactggaacgtaataaacgactgtgctgacacatcgtnttcc

SEQ ID NO: 170957 - DNA, 573 bp, Homo sapiens
  misc_feature: GYAE6OF01AUOOZ.27.78.H01.1.454.CMB.1.raw
  modified_base (351)..(351): a, c, t, g, unknown or other
  misc_feature (351)..(351): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagtcttacactggtaccagcagaagccaggtcagtctccaaagctcctcatcaagtatcgccttcccagtccttctcgacgggtcccctgaggttcagtggcagtgatcgnggacactacttccaccctcacctatacaatacgcctaggacgctagaagtatgctagactaacttattctgtcatacagtacgttacttactttacctacgaagttagtacttccgtaccgttaccggaccgtaaacgggaccaacggtaccgttagggaacgtaaagttaaaccggaacgttggtacgtacctcggtaccaaccgtcttcgtcggttaccc

SEQ ID NO: 170958 - DNA, 634 bp, Homo sapiens
  misc_feature: GYAE6OF01EE8KF.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtatccaaagctcctcatcaagtatgccttccagtccttctcgacgggtcccctcgacggttcagtggcaggtggatcgtgggacactatttccaccctacaccactcaactacgacccgtaggaaacgcgtagaacgatacggtacttcggaccttaactttactttacttacgttactaacttacaacggtaacgttaacctttaaccttttaaccctacgttaaacgttacggtaactttacccgtaacccgtttaccgggaacccgtaaaaccgggggacctaaacccgggaccgttaaggggaaacgtaaacgtttaaaaacccggg

SEQ ID NO: 170959 - DNA, 869 bp, Homo sapiens
  misc_feature: GYAE6OF01CNMZT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaagtcacatcacctgccgggccagtcagagtcgttggtagtagcttacacgtcggtaccagcaagaacgtcaggtcaacgtctaccgaaagtcctcctactactacgtaagttactcgtaccttcccgacgttccctttccgtaccggtaccggggttcccccgtacggtacggttaccgtaacgggtcgggtaccgtaaggttacgggtaacgttccggtacggggaaccttaaccgtaacctttttacccaaccccttacctaacccgttaaactacctaaaacgttacgtacccggtacgggaaacgtaccggtaaggtaaacggtacgttacggtaccgtacggtaaaccctttaaaccgttttaacgtttaaccgttaggttaacctaacgtttaccgtaaacggttaaacgttttaacccttttaaacccgtttttaaccccgtaacgttaaacggtttaaccgtaaccgtttaaccccggtttaaccccggtttacccggggtaaacccgaaaaccgggggttaaacccgtaaccgggttaaaaccggtaacggggtaaacggtttaaaaccgttaaaaacccgggttaacggttaccgggtacgggttacctacggtacccttaaaccgtactttaccgttcggtttaccctttaacccc

SEQ ID NO: 170960 - DNA, 698 bp, Homo sapiens
  misc_feature: GYAE6OF01CO45G.27.78.H01.1.454.CMB.1.raw
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctggttccagcctcgagggtnaattgtgctgactcagtctccagtactttcagtctgtgactaccgaaagganaaacgtcacatcgacctcggccggcagtcgagagtcggttaggtagtagtaccttaacacgttacggaaccacgacaaggaacgccgaggtacacgtacctaccgaacgtcctcctacatacgtaagttactcgtaccttcccgacgtttccttcgtccggtacgggtcccccgttaggtacggttacgtaggtcggtcgtaggtggtaacgtcgtacggtaactaccgttacttacccaccccttaccaaaccgtaataaccgtaaacgtaccgacggttaaggaaccgtagtaacgaacgtagtcgtactacggtaaccttaactttacgttactacgtactaacttacgaacgttaacttaacctttacttaacctacgttaacgtacgtaccgttaccgtaccgtaccggtaacgaacggaacgtaaccgtagtacgtaaacgtaaactaaagacgttaggacgtactacgactaaactggtaactcgttaccgtaccg

SEQ ID NO: 170961 - DNA, 834 bp, Homo sapiens
  misc_feature: GYAE6OF01CU563.27.78.H01.1.454.CMB.1.raw
  modified_base (135)..(135): a, c, t, g, unknown or other
  misc_feature (135)..(135): n is a, c, g, or t
  modified_base (181)..(181): a, c, t, g, unknown or other
  misc_feature (181)..(181): n is a, c, g, or t
  modified_base (333)..(333): a, c, t, g, unknown or other
  misc_feature (333)..(333): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcanaactcattgggtttctgctgctctgggttccagcctccgaggggtnaaattgtgctgactcagtctccagtactttcagtctgtgactacaaaggagaaagtcacatcaccgtggccggccagtcagagtcgttggtagtagcttacacgttaggaccagacgagaacgccaggtcagtcctacaaagtcctacctanaactactaaagtactcgtaccttacccgaacgttcccttacgtaccggtaaccggggttcccccgttacgggtaacgggtttccgaacgggtttcgggaccgtaagggttcggtaacgtaccggttacggggaacctaaccgttacgttttacccaaccccttaccaaccctaactaacgtaaacgttaccgtacccgtaagggtaaacgtccgttagaaacggtacgtacgtaccgtaacgtaaccgttaaaccttttaacgttaaccgttacggttaacctaacgttaacccggttaaagttaaacccgggttttaaaccctttaaacccgtttttaaaccccggttaacgtaaaaccgggtttcgtaaaccgtttaccccggtaaaacccccgggttttaccggggaaaaccccggtaaaaccgggggtaaaccctaaaccgggttaaacccggttaacggggtaaaacgttaaaaccgttttaaaaaaccccggggg

SEQ ID NO: 170962 - DNA, 564 bp, Homo sapiens
  misc_feature: GYAE6OF01BI2E1.27.78.H01.1.454.CMB.1.raw
  modified_base (148)..(148): a, c, t, g, unknown or other
  misc_feature (148)..(148): n is a, c, g, or t
  modified_base (197)..(197): a, c, t, g, unknown or other
  misc_feature (197)..(197): n is a, c, g, or t
  modified_base (403)..(403): a, c, t, g, unknown or other
  misc_feature (403)..(403): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtnaattgtgctgactcagtctccagtactttcagtctgtgactcaaagganaagtcacatcacctgccgggccagtcagagcgttggtagtagcttacacgtggtaccagcagaacgccaggtcagtcctaccgaaagtctcctcatcaagtactgccttcccagttccttctcgacggggttcccctggaggttccagtcggctaggtggatcgtggactacgtactttcaccctcacatacaatacgctaggaancgtagaagatcgctgactaacttacttactgttacataccagacgtacttaccttacgtactaagtcgtactactaccgttccggaccgtaacggacaacggactaggtagtaattaacggtactaggtacgtcgtacgtacctaccacgttgtcgttacc

SEQ ID NO: 170963 - DNA, 641 bp, Homo sapiens
  misc_feature: GYAE6OF01BGDVZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagctttacgactgggtaccagcaagaagccaggtcagtctccaaagctcctcatcaagtatgccttcccagtccttctcgacgggtcccctcgagttcagtggcgagtggactcgtgggacactacgtttccacccttcaacctatcaaactagccctaggaacggtcctagtaacgaatcggacttacggacctaaacgtttaactttaccgttaggttacctaactctaacggttaacgttaaccttaaccttttacccgtacgtaacggttcgtaacgttacctaccgttaccgggaccgtaaaccgggtacaaccggtaacgtaggaaacgtaacgttaaacggacggttcggtacgtacgtacggtacctaccgtagttcccttggttcctttacccg

SEQ ID NO: 170964 - DNA, 587 bp, Homo sapiens
  misc_feature: GYAE6OF01B1CSC.27.78.H01.1.454.CMB.1.raw
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (578)..(578): a, c, t, g, unknown or other
  misc_feature (578)..(578): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccggcagtcagagtcgttggtagtagcttacactggtaccagcagaagccaggtcagtctacaaagctcctcatcaagtatcgccttcccacgtcccttcgtccgacggggttccccctacggtacggttcaggtggcgtaggtcggatcgtagggacacgtactttcaccctcaccatacaatacgccgtaggaanctagaanagtgactagtacttaacttatacttgtacatacagtattaaccttactttaacctacgtaagtcgtactaccgtacgttccggacgaacgggaccacggtacgtaaggtaactaacgttaaacgacgttggtacgaccgtacgacctacctatccgttntcgttaccg

SEQ ID NO: 170965 - DNA, 695 bp, Homo sapiens
  misc_feature: GYAE6OF01ATN84.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgtacggttccaggtcggcaggtggatcgtggggacacgtacttttccaccccgttcaaccctactaccaaacttacggacccgtagggaaacgtccttaggaaacgtacttacggaccgttacggtaaccttaaaaccttttaacgtttaacccgtttaggttaccctaagttaccgaaagtaacggtttaacctttaacccgtttttaaccctacgtaaaggtttacgtaacttacccttaacccgtttccgggacccgaaacggggtaccaaccggtaacgttacgggtaacgtaaacgtttaaaaccggaacgttcgggttacggtacttacggtcctaaccctaagttccgttcgttccttaccg

SEQ ID NO: 170966 - DNA, 577 bp, Homo sapiens
  misc_feature: GYAE6OF01DMLOY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaagtcaccatcacctgccggccagtcagagcgttgtagtagcttacactggtaccagcgagaagccaggtcagtctaccaaagcctcctcatcaagtatcgcttcctacgttccttcgtccgacgggtcccctaggtacgttcgagtggcagtggactcgtcgggactactactttccaccctcacccatactaatacgctaggacgtctagaagctgctagactaactttatacgtgtacacgtacagtaacgttaaccttacttaccctagtaacgtacgtaactcctacccgttaccggaccgaaacgggtaccaacggtacgtacggaaggtaagttaaaaccgg

SEQ ID NO: 170967 - DNA, 718 bp, Homo sapiens
  misc_feature: GYAE6OF01BLDG4.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaaattgtgctgactcagtctccagtactttcagtctgtcgactaccgaaaggagaaacgtcaccatccaccgtcggccggccagtcagagtcggttaggtagtagtcttacacgttggtaccagacaagaagccgaggtcacgtcctaccaaacgcctcctcatacaagtatcgaccttcccagttcccttcgtccggtaccggggtcccctacggtacggttcgacggtcggaccgtaggtcggacgttcggtacggggaacctacgttacctttacccgacccctactaaccctaacttacctaaagttaccggaccgttagggaaacgtacgtaacggaagtacgtacgtactacgtaaccttaaactttaacgtttacgttacgttacctaacgttaccgtaaggttaaccttaacctttaacctttaacccgtaacgttaacgttacgtaacctaccgttaccccggttacggtaacccggtaacgggtaacctaacggtaaccgtacgggtaaagtaaacggttaaaaccggg

SEQ ID NO: 170968 - DNA, 750 bp, Homo sapiens
  misc_feature: GYAE6OF01B0YPB.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgagggtgaaattgtgctgactcagtctccagactttcagtctgtgactccaaaggagaaagtcaccatcacctgccggccagtcagagcgttggtagtagcttacacgtggtaccagcagaagccaggtcagtctaccaaagcctcctcatacaagtatgtccttcccagttcccttctcgtacggggtcccctggtacggttcgaggttcggactaggtaggacgttcgtggggaacctacgttaacttttcccaaccccttacaaccctaactaccgtaaagttacggacccgtaagggtaaacgtccgttaaggaaaacgtacgttacggtaccgttaaggtaacccgttaaaccttttaacgtttaacccgttcgtttaacctaaccgttacgtaacggtaaccgttttaacctttaaacccgtttttaacccgtacggtaaacgttacgtaacttaccccgtaacccgtttaccgggacccgtaaacggggtaacccgtaaccggtaacgttacgggaaacgttaaaccgttaaaacggttaccggtacggttacggtaccgttacggaacccctaaccgtaccgtttacgtccggtttaaccc

SEQ ID NO: 170969 - DNA, 568 bp, Homo sapiens
  misc_feature: GYAE6OF01BLYD6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctccaaagctcctcatcaagtatgcttcccagtccttctcgacgggtcccctgacggttcagtggcagtggatcgtgggacactagtttccaccctcacccattccaaattacgccttaggaacgcgttagaaagctgactgacctaaacttacttacctgtacatcaagtagtaccttactttaccacaagtcgatccaccgttcggacctaagggaccacgtactaggaacgtaacgttaaacgaactcggtacggtactcggaaccctacctaattcctcggttccttaccg

SEQ ID NO: 170970 - DNA, 578 bp, Homo sapiens
  misc_feature: GYAE6OF01CLSTI.27.78.H01.1.454.CMB.1.raw
  modified_base (179)..(179): a, c, t, g, unknown or other
  misc_feature (179)..(179): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaagtcacatcacctgccggccagtcagagcgttggtagtagcttacactggtaccagcagaagccaggtcagtcctaccaaagcctcctcactacaagtactcgcttcccagttccttcgtccgtacggggtcccctcggtacggttcacggttggacaggtcggtaactcgtcgggaactacgtactttccacccgtcacctatacaactacgcctaggaacnctagaanatgactgtactaacttatactgtacatcagtacgttacttacttacctcgtaagtcgtatcctaccgttcggaaccgtaacggtacctaacggagtacggaagtaaacgttaaaccgg

SEQ ID NO: 170971 - DNA, 683 bp, Homo sapiens
  misc_feature: GYAE6OF01C389H.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccaccgtgccgggccagtcagagtcgttggtagtagcttacacgtcggtaccagcaagaacgccgaggtaccagtcctaccaaacgcctcctacatacaagtatcgccttcccagttcccttcgtcgtaccggggttcccctcggtacggttccaggtggacctaggtggacgtcgtacgggactacttactttccacccctacacctactacaacgtacgcctagggaacgcgtagaagtatcgactagacctaaactttacttactcgtacactactaaggtactttaaccgttacttttaacccacgtaacgttacgtaacttcccgtaacccgtttaccgggacccggtaaagggtaacccgaaacggtaccgttaagggaaacgttaaaacgttaaaacccggtacgttagggtaccggtaccgtaccggtacctaaccccttagtttcccgtcgtttccttaacccg

SEQ ID NO: 170972 - DNA, 664 bp, Homo sapiens
  misc_feature: GYAE6OF01DF2WN.27.78.H01.1.454.CMB.1.raw
  modified_base (148)..(148): a, c, t, g, unknown or other
  misc_feature (148)..(148): n is a, c, g, or t
  modified_base (310)..(310): a, c, t, g, unknown or other
  misc_feature (310)..(310): n is a, c, g, or t
tcagagcgtcgtctcacgaccggtgctcgatttagtgtgagtagtttgggtttggggggcatgagcaaaactgacaagtcaaggcaggaagatgtgccatcacaactcattgggtttctgctgctctgggttccagcctcgaggggtnaaattgtgctgactcagtctccagtactttcagtctggtcgactaccgaaaagggagaaacgtcaccatccacctggccggcagtcaggagcgttggtagtagcttacacgtggtaccagcagaacgccgaggtcagtccacaaagtctctacagacaagtntcgccttcccaagttccctcgtcgtacgggtcccctggaggttcagtggcaggtggtactggtacgggactacgtactttaccaccctactaaccctattaccgtaaacgtacgtacccgttaaggaaccgtcgtaacgaaaggtacgtcggacgtacgtaactaacctttagttactgtacgtacttacgtaaggtacttaacgtttaaccttaccgtacgtaacgttgtaacgtcccttaccggttaccggaaccggtaaacgggtaccgaacggtaacggaacggtaacgtaaagttaaaaccggtactacggtacggaccgttacgacccactacgttccgtgtttaccc

SEQ ID NO: 170973 - DNA, 703 bp, Homo sapiens
  misc_feature: GYAE6OF01CNAIF.27.78.H01.1.454.CMB.1.raw
  modified_base (371)..(371): a, c, t, g, unknown or other
  misc_feature (371)..(371): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgagggtgaaattgtgctgactcagtctcagactttcagtctgtgactaccaaaggagaaacgtcaaccatcacctgccgggccagtcagagtcgttggtagtagctacactggtaccagcaagaacgcaggtcagtcctacaaagcctcctacataccaagtatcgtccttacccacgttcccttcgtccgtaccgggtcccctggtacgttcgaggtgcgtagtgacgtcgnggacactacttccaccctcacactacatacgacgtaggaacgcgttaagaagtctaggtacctaggtaaccttaaactttacttaacggttcctagtaacgttacgtaaacggttaactttaaccttaaccgttttaaccgtaacgttaacggtaccgttaaccgttacccgtaaccggtttacccgggaaccggaaacgggggtaaaccaacgggtaccggttaaagggtaaacgttaaaaccggttaaaccggtaaacggttcggggttaaccggtcgttaaccgtaacccgtacccttaacggttaccttccggtttcctttaaacccc

SEQ ID NO: 170974 - DNA, 563 bp, Homo sapiens
  misc_feature: GYAE6OF01B8YQ1.27.78.H01.1.454.CMB.1.raw
  modified_base (411)..(411): a, c, t, g, unknown or other
  misc_feature (411)..(411): n is a, c, g, or t
tcagagcgtcgtctcacgaccggtgctcgatttagtgtgagtagtttgggtttgggatgagcaaaactgacaagtcaaggcaggaagatgttgccatcacaactcattgggttctgctgctctgggttccagcctccagggtgaaattgtgctgactcagtctccagtactttcagtctgtgactaccaaaggagaaagtcacatcacctgccggcagtcagagcgttggtagtagcttacactggtaccagacagaagccaggtcagtctaccaaagcctacctcatacaagtatcgccttccctagtccttctcgacgggtcccctaggtacggtcagtcggcagtggatcgtcggactactacttccaccctcaccatacaatacgccgtaggaacgcgtaggaacgntcgctagactaattattactgtactatcaggtacttacttacttaccatacgtacgtactaccaccgttacggaccgtaacggcaacgtaccgtaggacgtaacttaaagacgttcgaggtactacggtaccacgtattcttgtccgttacc

SEQ ID NO: 170975 - DNA, 777 bp, Homo sapiens
  misc_feature: GYAE6OF01EDPBY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaacgtcaccatccaccgtcggccggcagtcagagtcgttggtagtagcttacacgtcggtaccagcagaagccgaggtaccagtcctaccaaacgtctcctcatactaagtatcgtccttcccacgttcccttcgtccgtaccggggttcccctcgggtacgttcgacggtcgacgtaggtggtacgttcgtacggggaacctacgttactttcccaaccccgttacaacccctaataaccgaaagttaccgacccgttaagggaacgtaccgttaagaacggttacgttacggtaccgttacggtaacctttaaacgttttaaccgttaccgtttaaacggttaaccttaaccgttaacgtaacggttaaaccggttttaaaccctttaaacccgtttttaacccgtaaacgttaaaccgggtttccttaaacccgtttccccgttaaaccccgggtttcccgggaaaacccgtaaaccggggtaaaccctaaccgggtaaacggttacgggtaaacggtaaaacgtttaaaaaccccgggg

SEQ ID NO: 170976 - DNA, 565 bp, Homo sapiens
  misc_feature: GYAE6OF01CP4VR.27.78.H01.1.454.CMB.1.raw
  modified_base (401)..(401): a, c, t, g, unknown or other
  misc_feature (401)..(401): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatccacctgccgggccagtcagagcgttggtagtagcttacactggtaccagcagaagccaggtcagtctccaaagctcctcatcaagtatgcttcccagtccttctcgacgggtcccctcgacggttcagtggcaggtgatcgtagggacactattccaccctcaaccatacaatacgcctggaagtctagaanatgctgactaactttatactgtacactcaagtacttacttaactttaccataacgttgtactaccgtaaccgttccggaccgaaagggaccacgacgtaggaacgtaaacgttaaacggaacgttggtaggacttacggacctaaccatcctgttcctttaccg

SEQ ID NO: 170977 - DNA, 794 bp, Homo sapiens
  misc_feature: GYAE6OF01DYH3F.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggtccagcctccgaggggtagtaaattgtgctgactcagtctcagtacttcagtctgtacgactacgaaaggagaacgtcaccatcaccgtcggccggactacgtacgaggacggtcggttaggtacgtacgtccgttaacgtacgttacggtaccaggacgtaacggaacggccgaggttaccacgttacctaccgaaaacgtcctacctacataccgtaaagttctaccggtacccttaccgtaccgttccgtttaccgtacccgggtacccgggttccccgtacggtacggttaccgtaggtacggtacgtaggtacggtacgtcggtacgggaactaccttacttacccaccccgttacaaccgtaactacgtaacgttaaccggtcgtaacgggaactaccgtaaggtaacgtacgttacggaccgtttaacgtaaacctttaaaccgtttacgtttaccgttacgtaacccgttaataaccgtaaccgttaacgtttaaccgtttaacccctttaccgaagtttaaacgtacgttacccttacccggtaacccggttaccgggaaacccggaacccggtaacgttacggtaaaccggtaagggtaaaccttaaaacggttaaacccgg

SEQ ID NO: 170978 - DNA, 793 bp, Homo sapiens
  misc_feature: GYAE6OF01CI8VG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctcagactttcagtctgtgactccaaaggagaaagtcaccatcaccgtcgccgggccagtcaggagtcggttggtagtagtcttacactggtaccagacaagacgccaggtacagtcctaccaaagtcctctacatacctaagtactcgtccttacccacgttaccctttcctccggtaaccggggttcccccgttacgggtacggttacgtaacgggttcggaccgtaggtacgggacgttcggtaggggaacctaccgtacgttttacccaacccctacctaaccctaacgtaaccaaacgttacggtacccgtaaggggaacgtaccgtaagggtaaacgtacgttacgtaacctttaactaaaaccgttttacgttaacgtttcggttaacctaacgttaacgtaacggttaactttaaacccttttaaccttttaacccgtaaccgttaaacgttacgtaaaccttacccggtaacccgtttaccgggaaccggtaaacggtaaccggtaccggtaacggtaagggtaaacaaaacgggtttaaaaccgtaaggttacggttaacgggcttaaccgggaccctaaccgttacgttacgtttaccggttaccttcgttaaccccg

SEQ ID NO: 170979 - DNA, 640 bp, Homo sapiens
  misc_feature: GYAE6OF01CCNQQ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaaggcaggaagatgttgccatcacaactcattgggtttctgctgctctgggttccagcctccaggggtgaaattgtgctgactcagtctccagtactttcagtctgtgactccaaaggagaaagtcaccatcacctgccggccagtcagagcgttggtagtagcttacatggtaccagcagaacgccaaggtcagtctaccaaagcctcctacatctaagtatcgccttccacgttccttctcgacgggtcccctgtacgtcacgtggcaggtcggatcggtgggaacacgtatttccccgacctcaaccctactacaaactacgaccgtacggtaacgctaagaagagttcgacgtcgtaacttaaccgtttaattaccgtcgttaaccattactaaggaacgtttaaccttaccttttaaccctacgtaaacgttgtaacccttactaaccccgggttaccgtaacccggaaaggggtaccccaagggtaacccgttaaggggaaaccttaaagttaaaacccgggg

SEQ ID NO: 170980 - DNA, 588 bp, Homo sapiens
  misc_feature: GYAE6OF01BYF4N.27.78.H01.1.454.CMB.1.raw
  modified_base (177)..(177): a, c, t, g, unknown or other
  misc_feature (177)..(177): n is a, c, g, or t
  modified_base (345)..(345): a, c, t, g, unknown or other
  misc_feature (345)..(345): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcagggtnaaattgtgctgactcagtctccagtactttcagtctgtgactaccaaaggagaaagtcaccatcacctggccggcagtcagagcgttggtagtagcttacactggtaccagcagaagccagtcagtctaccaaagctcctcatcaagtatgccttcccagttccttcncgtacgggtcccctaggtacggttcagtggcaggtggactcgtgggactctactttcacccctcacccatacaatacgccgtaggaacgtcgtagaacgtatgactaggacctaactttacttaacgtcgttacataccagtaacgttaccttaactttacctacgtaagttcgtaacttcctaacccgttacggaaccgaacgggtacaacgtaacgtaggtaacgtaaagttaaaacccgg

SEQ ID NO: 170981 - DNA, 555 bp, Homo sapiens
  misc_feature: GYAE6OF01A0N9S.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtatagcttacactggaccagcagaagccaggtcagtctaccaaagcctcctcatcaagtatgcttcccagtccttctcgacgggtcccctcgaggttcagtggcagtggatcgtgggacactatttcaccctacaccatcaatacgcctaggaacgctagaagtactgctcgtactaactttattactcgtctatacaagtacttaacttacctttacctactaagtgactacctaccgttcggaccgaagggaccacggtacgtacgggtaagaacgttaaacgacgtgtcggactacgaccacctatctgttcttaccg

SEQ ID NO: 170982 - DNA, 582 bp, Homo sapiens
  misc_feature: GYAE6OF01B7CVX.27.78.H01.1.454.CMB.1.raw
  modified_base (328)..(328): a, c, t, g, unknown or other
  misc_feature (328)..(328): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtntcgtccttcccagtccttctcgacgggtcccctcgacggttcagtggcaggtggatcgtggacactacttccaccctcaaccctatacaactacgccgtaggaacgtcgtagaagntcgactgactaacttattactntactatcgagtacgttaccttacctttacctactaagtcgtacttacccgttaccgttacccgggaccgtaacgggaaccgaccggaacgtacgggtaagtaacgtttaaaaccgg

SEQ ID NO: 170983 - DNA, 688 bp, Homo sapiens
  misc_feature: GYAE6OF01DE4BF.27.78.H01.1.454.CMB.1.raw
  modified_base (150)..(150): a, c, t, g, unknown or other
  misc_feature (150)..(150): n is a, c, g, or t
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggtccagcctcgagggtgtaattgngctgtactcagtctacctagtactttcagtctgngactacaaaggagaaagtccacntcgaccgtcgccgggaccaggtccgacgtgtcgttggtacgtacgtcttacacgtcggtaccagacaagaacgcgtaaggtctacgtcctaccgaaagtcctcctacgctacgaagtgtcgccgttccgacgttccttacgtccggtaccggtccccgtgtacgttacgagtggcgaagtgactcggtcggaactactacttccaccctcacctataccgtaacgtacgtaccgtaggaacgtcaaggaacgtagttcgactaacgtacttaacttacgttacgtagttacaacttacgtaacggttaacttaacctttaacgtttaacctacggaaacgttcgtaaacgttacccgtaccggtacggtaaccggaacgggtaactacggtaacggtagtaacgtaaaacgttaaccggagtcggttaggtacccgtacggtccgtaaacgtactttcccggttagttcccgtttaacccg

SEQ ID NO: 170984 - DNA, 615 bp, Homo sapiens
  misc_feature: GYAE6OF01BNOJU.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttccagtccttctcacgggtccctcgaggttcagtggcagtggatctgggactacgtactttcaccctcaccatacaaatacgaccgtaggaagccgtagaacgtataggacctaggactaaactttacttaactgtacactacaagtaacgttaaccttaactttacctactaaaggttgaacgttacctaacccgtttaccgggaacccgaaacggggacctaaccggtactagggtaaacgtaacgtttaaaccggaacgttggtacggtacctacggtacctacccgtagttcccgttcggttccgtttaacccg

SEQ ID NO: 170985 - DNA, 670 bp, Homo sapiens
  misc_feature: GYAE6OF01EX82S.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaattgtgctgactcagtctccagtactttcagtctgtgactaccgaaaaggagaaagtcaccatccaccgtggccgggccagtcaggagtcggttggtagtagcttacacgtgtaccagcagaacgccaggtcagtctaccaaagctcctcatcaagtactcgtccttcccgtacgttacccttcctcgtaccggggttccccctcggtacggttcaacggtggaccgtaggtcggtatcggtcgggactacgtactttccaacccctcaacctatacaagtacgtcctagggaaactcgtaagaagtatcgtactcggaacttaactttacttacgtcgtactagtactagtaacgttaccttacgtttacctactaagttacgtaacttccgtaacccggttacgaacccgtaacgggtaacctaccggtaacgtacgggtaaacgttaacggttaaaaccgtacggttacggtaggtaccgtaccgtacaacccgttcttaccgttggtttaacccc

SEQ ID NO: 170986 - DNA, 660 bp, Homo sapiens
  misc_feature: GYAE6OF01BIKIW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaagtcaccatccacctggccgggccagtcagagcggttaggtagtagcttacacgtggtaccagcaagaacgccaggtcagtctaccaagcctcctcatacaagtactcgtccttacccacgttccttcgtccgtaccggggtcccctcggtacggttcgaggtcggcgtaagtcggtacgtcgtacgggactactacgtttccaacccgtccaacctactacaaatacgaccgtaggaacgacgtagaagagtcgactacgtacctaaatttacttaacgttgtacctaagttacgtaacgttaacttaccgtttaactttaacctacgtaagttgtaacctaccgttacccgttacgggacccgaaacgggaccgtaccgaacgtaggaaacgtaaacgttaaaccgacgttacggtacgtacgtaccgcctaacctagttccttcgttccgttacc

SEQ ID NO: 170987 - DNA, 611 bp, Homo sapiens
  misc_feature: GYAE6OF01BIUB2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcgacgggtcccctcgtagttcagtggcaggtggatcgtagggacactactttccacccctcaccatcaatacgcctaggaagtctagaagatgctgactaacttacttacgtgtactatcaagtacgttaaccttaactttaccctactaagttcgtaacttccgtacccgtttaccggacccgaaacggggtacctaccggtaaccgtaagggtaacgtaaacgttaaaaccggtaaacgttcggtacggtaccgttacggaccctacctaaccgtttcgttccggttactttacccg

SEQ ID NO: 170988 - DNA, 677 bp, Homo sapiens
  misc_feature: GYAE6OF01CN4T8.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagactttcagtctgtgactccaaaggagaaagtcaccatccaccgtgccgggccagtcagagcgttggtagtagcttacactggtaccagcagaagccaggtcagtctcaaagctcctcatcaagtatcgcttcccagttccttctcgacgggttcccctcggtaggttcgagtcggcaggtggactcgtacgggacaacgtacttttccaaccccgttcaacccgtataccaaatacgcccgtaggaacgtcttaggaacgtagtcgtcgttaggtaacctaaacttttacgttaaccgttagttacctaacttacgtaacgtaacgtttaacctttaacctttttaacccaacgttaagttcgtaacgttacctaaccccgtttacgggaccctaaacggggtaaccaccggtacgttacgggaaacgtaaacgttaaaaccgaacggttcggtacggtaccgttaccggtacctaacccgtattaccgttcgttccgtttaacccg

SEQ ID NO: 170989 - DNA, 594 bp, Homo sapiens
  misc_feature: GYAE6OF01A4LKR.27.78.H01.1.454.CMB.1.raw
  modified_base (285)..(285): a, c, t, g, unknown or other
  misc_feature (285)..(285): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctgccggccagtcagagcgttggtagtagcttacactggtaccagcagaagccaggtcagtctcaagctcncatcaagtatcgcttcccagttcccttctcgacgggttccccctcggtacggttcaggtggcaggtggatcgtagggacactactttccacccctacacctatacaatacgaccgtaggaacgctagaaagtatcgctacgactaactttattactgtacatacagtacgttacttaacctttacctactaagttctacttacctaccgttacggacccgaagggaccctacggaaccgtaggaaacgtaacgttaaacggaacgttcggtaggtaccgtacgacctacctacgttccgtcggtttacc

SEQ ID NO: 170990 - DNA, 565 bp, Homo sapiens
  misc_feature: GYAE6OF01B3TLG.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaaggagaaagtcaccatcacctgccgggccagtcagagcgttggtagtagcttacacgtggtaccagcagaagccaggtcagtctccaaagctcctcatcaagtatgccttcccagtccttctcgacggggtcccctcgaggttcagtggcaggtggatcgtgggacactactttccaccctcaaccatacaatacgccctaggaacgtctagaaagatgctgactaactttattactgtcatcagtacgttactactttacctctaagtgtacttcaccgttacggaccaaggggaccacggaacgtacgggaacgtaagttaaacggacgttggtacggacgttcgaccacctattccgtgtttaccc

SEQ ID NO: 170991 - DNA, 561 bp, Homo sapiens
  misc_feature: GYAE6OF01E5D5W.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatcgcttcccagtcccttctcgacggggtcccctcgaggttcagtggcagtggatcgtgggacacactttccaccctcaccatcaatagcctaggaacgctgaagagtgctgctaacttattactgtacatcagtacgtactactttacctactaagtcgtatcctaccgtttcggacccgtaaagggccaacggtactagggaagtaacgttaaaacggaacttggtcggtacgttacggaccacctattccttggttccttacc

SEQ ID NO: 170992 - DNA, 646 bp, Homo sapiens
  misc_feature: GYAE6OF01A9BUF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccgggccagtcagagtcgttaggtagtagcttacactggtaccagcagaagccaggtcagtctcaaagcctcctcatcaagtatgccttccagtccttctcgacgggtcccctcgacggttcgagtggcgtagtggatcgtcgggactacgtactttccgacccctaccaacctacgtacaacgtacgacctagggaacgtccgttaaggaacgtagtacgtaccgtagacgttaaacctttagttaaccgtcgtactactaccgtaagtaacgtttaccttaacttttaccgtaactaacgttagtacttaccttaacccggttaccggacccgaaaagggtacctaacggtaacggtacggtagtaaacgttaaaccggtaattcgggtagtaccgtaccggaacctacgtaactcgttgtcgttacccg

SEQ ID NO: 170993 - DNA, 756 bp, Homo sapiens
  misc_feature: GYAE6OF01E1I54.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagtactttcagtctgtgactccgaaaaggagaaagtcaccatccaccgtggccggccagtcagagcgttggtagtagcttacactgtaccagcagagccaggtcagtctaccaaagcctcctcatcaagtactcgccttcccacgttcccttcgtccgtaccggggttccccctggtacggttccgaggttcgggacgtaggtcggacgttccggtacgggggtaacctaaccgttaccttttacccgacccccttacccaaccctaactactaaacgttaccggacccgtagggaaacgtcgtaacggaaagtacgttacgaccgttacggtaaccttaaaccttttaacgtttaaccgttacgttacctaacgttaccgaacggttaacgtttaaaccctttaacccgttttaaccctaaccgttaaacggttaccgttaaccgttaccccgttaaccccggtttacccgggaaaccccggtaaacggggtaaacccgtaaccgggtaaacgtaaccggggtaaaacgtaaaaccggtttaaaaacccggg

SEQ ID NO: 170994 - DNA, 582 bp, Homo sapiens
  misc_feature: GYAE6OF01CGDUS.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcaagaagccaggtcagtctaccaaagctcctcatcaagtatcgccttcccagttccttctccgacggggttccccctcggtaggttcagtggcaggtggatcgtgggacactactttccaccctcacccatacaatacgcctaggaacgctagaagatgctagctaactttattactgtacatcaagtacgttaaccttactttacctactaagttcgtacttcctacccgttcggacccgaaagggaccaacggtacgtagggaagtaacgttaaacgaacgttggtacggctacgacctaccctattccttgttcctttaccg

SEQ ID NO: 170995 - DNA, 621 bp, Homo sapiens
  misc_feature: GYAE6OF01CLNCP.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatccacctgccggccagtcaggagcgttggtagtagtcttacacgtggtaccagcagaacgccaggtcacgtctaccaaacgctcctcactcaagtatcgtccttcccagtccttccgtcgacggggttcccctcggtacggtctaggtcggcgagtggactcgtagggacctactactttcccacccttccaaccctatacaaacgtacgtacccgtagggaacgtctagtaagagtcggacctacgaaccttaaactttacttacgttacgtacctataccgtaagtacgttaacttacctttaccgtactaagtcgtaatcctacccgttaccggacccgaaagggtaccaacgtagaacggtaagtaaacttaaaaccgg

SEQ ID NO: 170996 - DNA, 711 bp, Homo sapiens
  misc_feature: GYAE6OF01DI8RV.27.78.H01.1.454.CMB.1.raw
tcagagcgtcgtctcacgaccggtgctcgatttagtgtgagtagtttgggttgggggcatgagcaaaactgacaagtcaaggcaggaagatgttgccatcacaactcattgggtttctgctgctctgggttccagcctccgaggggtgaaattgtgctgactcagtctccagtactttcagtctgtagactaccgaaaaggagaaacgtcaccaatccaccgtcggccgggacagtcagaggtcgttggtagtagtacttacacgtggtaaccagacgagaacgtccagggtcacggtacctacgaaacgtcctcctacacgttaccgaaagttcgtcgcctttccacggttcccttctaccggtaccgggtcccctaggtacggttcgaggtacggtcgagtcggtatcggtacggtacaccgttactttaccgaccccttacaccgtaatacctaaagtcgtaccgtaggtaacgtactaggtaaagtacgttagcgtacgttaaccttaacttaacttaccgtatacgttactacgtaagttaaccgttaacttacctttaacccgtactaacggtagttaacctaccgtaaccggttaccggaaccgtaacgggtaccgaaccgtacgtaaggtaaacgtaacgttaaaccggtacgttacggtacgggtaccttacgaccttaacgacctttgtccgtttaacccg

SEQ ID NO: 170997 - DNA, 738 bp, Homo sapiens
  misc_feature: GYAE6OF01EZQXR.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactaccgaaaggagaaacgtccaccatccacctcgccgggccagtcgagagtcgttggtagtagtcttacacgtggtaccagacaagaacgccgaggtcacgtctaccaaacgctacctacatacgtaattagtcgtcccttcccgtacgttcccttcgtccgtaccgggttcccctggtacggttcgaggtcggacgtaggttggacgttcggtacgggacctaaccgttacttacccgtaccctacctaaccgtactacgtaacgttacgtaccggtaaggtaacgaccgtaggaacgtacgtcggtactacggtaaccttaacgtttacttaaccgttcgtaccttaactacgtaacgttaccgttaaccgtttaccttttaacccgtaacggttaaaccgttcgtaacctttacccgtacccgtacccggggtaaccgaaaccggggtaccaaccgggtaacgtaacggggtaacttaaaccggttaaaccggtaacgttcggacggtctaccggtaccctaacgttacctcgttccgtttaaccc

SEQ ID NO: 170998 - DNA, 585 bp, Homo sapiens
  misc_feature: GYAE6OF01COF2I.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaagtcaccatcacctgccggccagtcagagcgttggtagtagcttacactggtaccagcagaacgccagtcagtctaccaaagctcctcatacaagtatcgccttcccagttcccttctcgaccgggttcccctggtacggttcaggtcggcaggtcggagtcgtagggactacgtactttaccgaccctcacctactactaaatacgacctaggaacgactagaagtatcgtactagtacctaacttagttactgtactatacagtacgttaccttacttacctctaacgtcgtaactcctaccgttaccggaccgaacgggtactacggaacgtaggaacgtaacgttaaacgg

SEQ ID NO: 170999 - DNA, 577 bp, Homo sapiens
  misc_feature: GYAE6OF01B1HAL.27.78.H01.1.454.CMB.1.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaacgctcctcatcaagtactgtccttcccagttcccttctccgtacggggtcccctacggtacggttcaggtcggctaggtggatcgtggacactatttccaccctcaccatacaatacgcctaggaanctagaagntgctagactaacttattactgtacatcaagtacgtacttactttaccactagtcgtactcgtacccgttcggaccgaaggacctaaccgtacgtaggtaaagtaaactttaaacggaacgtggtacgtcgtacgtacccacgtaactcttcggttcttaccg

SEQ ID NO: 171000 - DNA, 670 bp, Homo sapiens
  misc_feature: GYAE6OF01C1RYR.27.78.H01.1.454.CMB.1.raw
  modified_base (226)..(226): a, c, t, g, unknown or other
  misc_feature (226)..(226): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagngcgttggtagtagcttacacgtgtaccagcagaacgccaggtcacgtctaccaaagcctcctacatacaagtactcgtccttccctacgttccctttcgtccgtaccgggtcccctcggtacggttcgaggtggcgtagtggatcgtggactactacttccaccctcaccataccaaagtacgacgtaggaacgacgtagaagtatcgacgtacgtaacttaaacgtttattacttgtactactactaacgtaacgttaacctttaaccgtttacctaataacggtactaccgtaccgttaacccgttaccgggacctaaacggggacctaaccgggtaaacggttaacgggaaacggttaaacgtttaaaaccggtaacggttcggttacgggtacctacgggtaccctaaccgttatttaccgttccgttccgtttaacccg

SEQ ID NO: 171001 - DNA, 748 bp, Homo sapiens
  misc_feature: GYAE6OF01B0WVR.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtgaaattgtgctgactcagtctccagtactttcagtctatgactaccaaaggagaaagtcaccatccacctggccgggccagtcaggagcgttgggtagtagcttacactcggtaccagcaaggaacgcccgaggtcacgtcctacccgaaagtcctcctacatacaaaggttactcgtcccttacccacgttccctttcgtccggtacggggttcccctcggtacggttccgaaggttcgggacctagggtcggtagttccggtaggggtaacctaaccttacgttttacccaacccccttactaacccgtaacttacaaacgttacggtacccgttagggaacgtccgtaaggtaacgacgttcgaccgttcgtaaaccttaacgttttaacttacgtcggtaactacttacgaaggttaaccgtttaacctttaacctttaaccgttaacgtaacggttacgtaacttacccgttacccgttaccggggaaccgaacggggtaccaaacggtacgtagggtaacgtaaaacgttaaacggacggtttcgggtaccgtcttaaccggactaaccctagtttccgtacgttccttaacccg

SEQ ID NO: 171002 - DNA, 546 bp, Homo sapiens
  misc_feature: GYAE6OF01E5KRJ.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggtagtagcttacactggtaccagcagaagccaggtcagtctaccaaagctcctcatcaagtatgcttcccagtccttctcagggtcccctcgacggttcagtggcagtggatctgggacactatttcaccctcaccatcaatagcctggaagctagaagatgctgactaacttattactgtcatacagtacttactactttacctacaagtnactacacccgttcggaccgaacgggacacgaacgtaggaagtaacttaaaccggaacgttgtacggtctacggccaacctattcgttgttcctttaccg

SEQ ID NO: 171003 - DNA, 593 bp, Homo sapiens
  misc_feature: GYAE6OF01C0VVL.27.78.H01.1.454.CMB.1.raw
  modified_base (278)..(278): a, c, t, g, unknown or other
  misc_feature (278)..(278): n is a, c, g, or t
  modified_base (345)..(345): a, c, t, g, unknown or other
  misc_feature (345)..(345): n is a, c, g, or t
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagtactttcagtctgtgactccaaaggagaaagtcaccatcacctgccggccagtcagagcgttggtagtagcttacnctggtaccagcagaagcaggtcagtctccaaagctcctcatacaagtatcgacttcccagtcccttntccgtacggggttcccctcggacgttcaggtgccgaagtcggatcgtgggaccacgtactttccacccttcaccgtactacaaatacgccttaggaacnccgtaagaagacgtgactacgaacctaatttacgtactgtacactacagtaacgttaacttaccttaccgtactacgtactattacctaccgttaaccgtcccgtaaacgggtaccaacgacgtacgggtaactaacggttaaaaccgg

SEQ ID NO: 171004 - DNA, 644 bp, Homo sapiens
  misc_feature: GYAE6OF01CT0N0.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagtactttcagtctgtgactccaaaggagaagtcaccatcacctgccggccagtcagagcgttggtagtagcttacactggtaccagcagaagccaggtcagtctaccaaagcctcctcatcaagtatcgcttcccagttcccttctcgaccggggttcccctcggtacggttcgaggtcggcgaggtggactcgtgggactacgtactttccacccctcaccctatacaaatcgccctaggaacgtcctaggaacgacgtgacctacgtacctaaactttacgttactcgtacattacaggttaacgttacctttaaccgttttacctacgtaaaggttccgtaacttacccgttaaccccggtttaccgggaaacccgtaaacgggggtaacccaacgggtaaccgtaacgggtaaacgttaaacgtttaaaaacccggg

SEQ ID NO: 171005 - DNA, 635 bp, Homo sapiens
  misc_feature: GYAE6OF01C4HLO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactacaaaggagaaagtcaccatcaccgtgccgggcagtcagagtcgttggtagtagcttacactggtaccagcaagaagccaggtcacgtctaccaaagtcctcctcataccaagtactgtccttcccacgttccttctcgaccgggttcccctcggtacggttcgaggtcggcgtaggtggacgtcgtcgggactacgtacttccaccctacacctatacaatacgaccgtaggaacgtctaaggaagtagtcgtacgtacggaaccttaaactttaactttactgtaacctagtacctaaggttaacgttaacctttaacctttaacccttactaacgttaacgtacttacccgttaccgttaccgggaccgtaaacgggaccaacggtaccgtaggaagtaaacgtaacggaactcggtacgctacgactacattctgtcttaaccg

SEQ ID NO: 171006 - DNA, 717 bp, Homo sapiens
  misc_feature: GYAE6OF01ENSG7.27.78.H01.1.454.CMB.1.raw
  modified_base (509)..(509): a, c, t, g, unknown or other
  misc_feature (509)..(509): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagaaattgtgctgactcagtctcagtactttcagtctgtcgactacgaaaggagaaagtcaaccatccaccgtcgccgggccagtcgagaggtcggttggtagtagtcttacacgtaggtaccagacaaggaacgccgaggtacacgtacctaaccaaacgtcctcctactaactacgtaaagtacgtcgtacccctttacccgtaacgttcccgtttacgccggtacccggggttaccccttacgggtacggttaccgagggtcggtactacggtaggtactcggtacgggaacctacgttaacttcccaacctaccaaccagttacaacgttacgccgttaaggaactcgtaaggagtanacgtctaacgtaacgttaaactttattactacgtactacgtacgtaacggttacttaacctttaacttaccgtagaaacgttcgtaacgttaccgtacggtaaccggaacgaaacggtaactacggtaacggtaacgtaacggtaaacttaaacggtacgtaggtacgacgttaccgaacgttaccagtttacctgttacccttaccg

SEQ ID NO: 171007 - DNA, 658 bp, Homo sapiens
  misc_feature: GYAE6OF01EVVLJ.27.78.H01.1.454.CMB.1.raw
  modified_base (528)..(528): a, c, t, g, unknown or other
  misc_feature (528)..(528): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgaggggtgaaattgtgctgactcagtctccagtactttcagtctgtgactaccgaaaggacgaaagtccaaccgactcaccgtcggcccgggcagtcaggacggtcggttaggtagtacgtcttacgacgtacggtaccaggcaaggacgccgaggtcacgtaccaccaagtcctacctcatactaagtctcgtacccttccgacgtttcccgttacgtccgggtacccgggttccctagggtacggttacgacgggttcggacgtggttacggacgttcgggtacgggaactaccgttactttcccacccttacactaactacaacgttaccaccggtagaacgtcgtagaagtnttcgacgtagtacctttaacttactttacgtactaccgtaatacgaacgttaacttaccttacgttaacctagtacgtacgtataccgtacgtaccgaacgtacggacacgtagtaggataacgttaacg

SEQ ID NO: 171008 - DNA, 658 bp, Homo sapiens
  misc_feature: GYAE6OF01DUFQG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactcggtacagcagaagccaggtcagtctaccaaagctcctcatacaagtatcgccttccacgttccttcgtcgtacggggtcccctcgtacggttcgaggtcggcgtaggtggtacgtcgtacggggactaactacgttttacccacccctaccaccctatactaaactacgtaccgtaggaacgcgtagaagtacgttgaccttaggaaccttaaaccgtttatttaaccgttgttacctaacttaccgaagttaacgttaacctttaacctttacccttaagaacggttacgtaacttacccgtaacccgtttaccgggaacccgtaaacgggtaccctaacggtaccgttaacgggaagtaaacgttaaaaacccgg

SEQ ID NO: 171009 - DNA, 547 bp, Homo sapiens
  misc_feature: GYAE6OF01D7LT4.27.78.H01.1.454.CMB.1.raw
  modified_base (401)..(401): a, c, t, g, unknown or other
  misc_feature (401)..(401): n is a, c, g, or t
  modified_base (536)..(536): a, c, t, g, unknown or other
  misc_feature (536)..(536): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgagttcagtggcagtggatcgtgggacactacttccaccctcaccatcaagtcgcctaggacgtcgtagaaagntgctgacctaacgtttattacgtgtacagtcaagtagttaccttaactttacctagtaacgttcactcctaccgttccggaccgaagggaccacgactagggacgttaataaacggacgtgtgcgtcgacacctntcgtgttaccc

SEQ ID NO: 171010 - DNA, 689 bp, Homo sapiens
  misc_feature: GYAE6OF01CD12X.27.78.H01.1.454.CMB.1.raw
tcagagcgtcgtctcacgaccggtgctcgatttagtgtgagtagttgggttgggatgagcgaaaactgacaaggtcaaggcacggaagactgttgcctactcgactaacctctattgggtttctgctgctcgtgggtaccagccgtccgagggtagaaattggtggcgtggactgagtctccgtaagttaccttttcgagttacttaggtcgtaacctaccgaaaggagaaaagtccaccatcgacgtggccggcgagtcaggagtcgttggtagtacgccgttaccagtcggacgacgcgagacgcgacgtcgtacgtacctacgtaacgtcctactactatacgtagtactcgtcctccgtacgtccgttcgtccggtaccggtcccgtacggtacggtacgtacggtcggtacggtaggtaggtacgtcggtacggtacgtacgtaccgttacctacccgtacgacctacgtactaacgtacgtacgtaggtacgtacgtacgtaagtcgtacggtacgtacgtaacgttaacttacgtacgttacgtactacgtacgtaacgtaacttaaccttaccgttaacgtacgtagtacgtacgtaccgtacgtaccgacgtaacgacgacgacgtagtaacgtaacgtaacgcgtcgtacgtacgtacgtacactacgtctcgtctacg

SEQ ID NO: 171011 - DNA, 786 bp, Homo sapiens
  misc_feature: GYAE6OF01BJLSW.27.78.H01.1.454.CMB.1.raw
  modified_base (297)..(297): a, c, t, g, unknown or other
  misc_feature (297)..(297): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaagtcaccatcacctgccggccagtcagagcgttggtagtagtcttacactggtaccagcagaagccaggtcacgtctaccaaagcctacctcatacaagtntacgcttcccagtccttctcgtacgggtcccctacgtacggttcgagtcggacgacgtggtacgtcgtacgggaacctactaccgttttccaaccccttaccaaccctaaacttacccgaaaacgttacgtaccccggttaaggtaaacgtaccgttaacggtaaacggtacttacggtccttaacggtaacccgtttaaaacttttaaccgtttacggttaaccgttaccgtaaacttccgaaacgggtttaaccgtttaaacccttttaacccgttttaaccccgtaacgttaaacggtttccgtaaacccgtttaccgttaaccccgtttaaccccgggaaccggtaaaaccgggggaaacccttaacccgggaaccgtttaaacggggaaaggttaaaaccgttaaaacccgggttaacgttcgggttacggtacccgtacggtacccttaaccgtacgttacgttaccgttccctttaaccccg

SEQ ID NO: 171012 - DNA, 608 bp, Homo sapiens
  misc_feature: GYAE6OF01C65N0.27.78.H01.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
  modified_base (497)..(497): a, c, t, g, unknown or other
  misc_feature (497)..(497): n is a, c, g, or t
  modified_base (527)..(527): a, c, t, g, unknown or other
  misc_feature (527)..(527): n is a, c, g, or t
  modified_base (553)..(553): a, c, t, g, unknown or other
  misc_feature (553)..(553): n is a, c, g, or t
  modified_base (604)..(604): a, c, t, g, unknown or other
  misc_feature (604)..(604): n is a, c, g, or t
tcagagcgtcgtctcacgaccggtgctcgatttagtgtgagtagtttgggtttggggatgagacaaaactgacaagtcaaggcaggagatgttgccatcacaactcattgggttctgctgctctgggtccagcctccgaggggtanaattgtgctgactcagtctcagtactttcagtctgtacgactaccaaaggngtaaatccaccactccgacctcggcccgggctaggtcaggngtccgtttacggtagtacgtcttaacacgttcggaccaggacaagacgccgaggtcacgtacctaccgaacgtcctacctacacttaccgaagtactccgtaccttcccgtacgttcctttcgtcggtaacccgggttccccgtggtacggtcgtaggtcggacaggtgtactcggtaggactactacttaccaccctcaaccnttacagtacgtcgagacnctagacgtancgctacgtactactttagtactgatanatagtaccttacttaccttacacgtatacncttacaccgtcggacgaaggtcctanacgtagaataaacgttaacgacttggacgctacaccgacttctacgtcttntccg

SEQ ID NO: 171013 - DNA, 661 bp, Homo sapiens
  misc_feature: GYAE6OF01AFXM1.27.78.H01.1.454.CMB.1.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
  modified_base (562)..(562): a, c, t, g, unknown or other
  misc_feature (562)..(562): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaattgtgctgactcacgtctccagtactttcagtctgtacgactaccgaaagganaaacgtcaccatccaccgtcggccgggccagtcagacgtcgttaggtagtacgtcttacacgttaggaccagacaagacgccgaggtcacgtactaccgaagtcctcctacactacgtaacggtattccgtcccttaccccgtaagtttccccctttacgtacccggtacccgggggttcccccttacggttacggttaccgaagggttcgggactaggtacggtactcgggttacgggacttaccgtactttcccaccctaccacctactacgtaataccgcgtacggaacgaccgtagatactgcctagaccttaattctacgttnactactacgactacttacttaccttacaacgtacgtactacgtccgtaccggttaccgacggacggtaccacgtacgtacggtagtaaacccttaacgg

SEQ ID NO: 171014 - DNA, 659 bp, Homo sapiens
  misc_feature: GYAE6OF01E37W8.27.78.H01.1.454.CMB.1.raw
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagtactttcagtctgtgactccgaaaggagaaagtcaccatcacctgccggccagtcagagcgttggtagtagcttacactggtaccagcagaagccgaggtcacgtctaccaaacgcctcctacatcaagtatcgtccttacccgtacgttccttcctccggtaacggggttccccctacggtacggtttcgaggtcgggcgtacggtggtagtccggtaggggaacctacttacgtttcccaaccccgttccaaccctataaccaactacggaccgtaggaacgacgtaggaaagntacgcgttacgaccttaacgttacttacgttgtactactactacgtaacgttaaccttactttaccctagtaaacggttcgtaacgttacccgtcccgttaccgtaacccggaaacgggtaaccaccggtaacggtcggtaaagtaaacggttaaaaccgg

SEQ ID NO: 171015 - DNA, 605 bp, Homo sapiens
  misc_feature: GYAE6OF01CWMYI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccagtcagtctccaaagctcctcatcaagtatgcttccagtccttactcacgggtcccctgaggtcagtcggcaggtggatcgtgggactacgtactttaccgaccctcaacccgataccaaatacgccctagggaacgccgtagaaagtatggaccttcggaacctaaactttactttacctggtacctaattacagtaacgttaacttaccttttaaccctacgtaaacgtcgtaacttaccgtaacccgtttcgggaacccgaaacgggacccaacggaccgttacgggaagtaagttaaaaaccggg

SEQ ID NO: 171016 - DNA, 721 bp, Homo sapiens
  misc_feature: GYAE6OF01BK9TZ.27.78.H01.1.454.CMB.1.raw
  modified_base (297)..(297): a, c, t, g, unknown or other
  misc_feature (297)..(297): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctccaaagctcctcatcaagtntcgcttcccagtccttctcgacgggtcccctgtaggttcaggtcggcaggtggatcgtagggactacgtattaccaccctaccgaacctaagtacctaaacgttaaccgtacgggaaacgtaccgtaaggtaaacggtacttacggaccttacggtaaaccctaaacttttaacttaccgttacgttaactacttacgtaacgttaacggttaaccctttaaccgttttaacccttaacgtaaacgggttctaaccgttacccgttaacccgttaccgggtaacccgtaaacggggtaaaccctaaccgggtaaccggttaagggtaaacggttaaaccgttaaaaccgggtaaccgttacgggtaccggtaccgttacggaaccttaacccgtatttcccgtacggtttaccctttaacccgg

SEQ ID NO: 171017 - DNA, 637 bp, Homo sapiens
  misc_feature: GYAE6OF01AG4E1.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctgccgggccagtcagagcgttggtagtagcttacactggtaccagcagaacgccaggtcagtctcaaagcctcctcatcaatatgccttcccagtccttctcgtacgggtcccctcgacggttcagtggctaggtgatcgtgggacactactttccaccctacaaccgtactacaacgtacgccgtacggaagtccgtaagaacggtatcggcttacgaccttaaccgtttnttaacgttagtccattaccgaagtacggttaacctttaccgtttaacctacgtaaggttactaacttacccgtaaccggttccggaaaccggtaacgggtaacaccgtacgtaacgggtaacgtaaacgttaaaacggtacgttacggtacggacgtcggacctaacccgtacttccgttccggtttacc

SEQ ID NO: 171018 - DNA, 935 bp, Homo sapiens
  misc_feature: GYAE6OF01EP9LU.27.78.H01.1.454.CMB.1.raw
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaattgtgctgactcagtctccagtactttcagtctgtcgactaccgaaaggagaaacgtcaaccatccaccgtcggcccgggccagtcagagtcggtttggtagtagtcttaacacgtaggtaacccagaccgaaggaacgccgaagggtaccacggttacctacccgaaaacggtccttaccctacgtaacttacgtaaacgttactcggtaccctttacccgtaacgtttcccctttccgtacccggtaccgggggttaccccccttcggtaacgggtttccgtaagggttacgggaccgttagggtacggtacgttaccgggttacggggaacctaacccgttaacgtttttaccccaaccccctttacctaaccccgttaactaaccgtaaacgtttaaccgggtacccgtttaacggggaaacggtccgttaaacgggtaaaccggtaaggtttaccggtaccgtttaaccggttaaccctttaaaaccgtttttaacgtttaacccgtttaccggtttaaccttaaacgtttaaccgtaaacggttttaaaccggttaacccctttttaaaacccgtttttaaaccccgttaacgttaaaaacgggtttaccggttaaaccgttttacccccggttaaaccccggtttacccggggtaaaccccgggttaaaaaccgggggtacccaaacccggggttaaacccggtaaggggttaaaaaccgttaaaaccggttttaaaaaaccccgggg

SEQ ID NO: 171019 - DNA, 594 bp, Homo sapiens
  misc_feature: GYAE6OF01CPMAU.27.78.H01.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccgggcagtcagagcgttggtagtagcttacactggtacagcagaagccaggtcagtctacaagctccnatcaagtatgcctcccagtccttcgtacgtacggggtcccctggacggttcgaggtgcaggtggagtcgtagggactactactttccaccctcaacctatacaatacgcctagggaacgcgtagaacgtatcgactacgacttaacttacttactacgtacaactcgaacgtacgttacttaacctttaacctacgtaagtctactccgtaaccgttcggaaccgaagggacctacggaacgtaggaacgtaagttaaacgtacgttggtacgtccgtacggtacccaacgtacttccgttcgttaccc

SEQ ID NO: 171020 - DNA, 558 bp, Homo sapiens
  misc_feature: GYAE6OF01EBZT9.27.78.H01.1.454.CMB.1.raw
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttaacactggtaccagcagaagccaggtcagtctaccaaagctcctcatacaagtatcgccttcccagtccttctcgacgggtcccctcgaggttcagtggcagtggactcgtggacactactttccaccctcaacccataccaaagtacgccgtaggaagctagaagtatgctagactaactttattactgtactatcgaagtacgttacttactttaacctnaagtntactactaccgttcgaccgaaggacacggacgtggtaacgtaattaaacgaacgtggtacggctacgacctactatcttcgtcttacc

SEQ ID NO: 171021 - DNA, 601 bp, Homo sapiens
  misc_feature: GYAE6OF01CVMW7.27.78.H01.1.454.CMB.1.raw
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagtactttcagtctgtgactacaaaggagaaagtcaccatcacctgccggcagtcagagcgttaggtagtagtcttacactcggtaaccagcgaagaacgccgaggtctacgtcctaccaaagtcctcctactactacctaagtactcgtccttccctacggttccctttcgtccgaccggggttcccctacggacggttcgagtggctaggttgatcggnggactacgtacttccaccttcacatacaatacgtcagtaagcgttagaagtatcgactcgtaactaactttatctgtacatacagtaacgttaccttactttaccagtactgtactacctacggttacggaccgtaaggacctacgacgtaggtaacgtaagtaaaccgtaagtcgtaacggtctacgaccgtactagttctacgtccttacc

SEQ ID NO: 171022 - DNA, 587 bp, Homo sapiens
  misc_feature: GYAE6OF01DWPIB.27.78.H01.1.454.CMB.1.raw
  modified_base (456)..(456): a, c, t, g, unknown or other
  misc_feature (456)..(456): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccacctggccgggccagtcagagcgttggtagtagcttacactggtaccagcagaagccaggtcagtctaccaaagcctcctcatcaagtatcgtccttcccagttcccttctccgacggggttcccctcggtacggttcaggtggcgaggtggatcgtgggactactactttccaccctacacccatacaatacgccgtaggaagctagaagntgctgactaacttattactgtcctatacgagtaacgttaccttaacctttaccctataacgtcgtattccctacccgttaccgggacccaaacgggtaccaacgtacgtagggaagtaacgttaaaaccgg

SEQ ID NO: 171023 - DNA, 644 bp, Homo sapiens
  misc_feature: GYAE6OF01ACFOA.27.78.H01.1.454.CMB.1.raw
  modified_base (146)..(146): a, c, t, g, unknown or other
  misc_feature (146)..(146): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactaccaaaggagaaacgtcaccatcaccgtgccgggccagtcagagtcgttggtagtagcttacacgtggtaccagcagaagccaggtcagtcctaccaaagcctcctcactacgaagtatcgtccttaccctacgttcccttctaccgtaccggggttccccctcggtacggttccaggtcggacgtaggtggtacgtcgtacgggactacgtactttacccgaccctcaacctataccaaacgttacggaccgtagggaacgtcgtaggaacgtgtacgtntacgtactaaactttattacgtcgtactatccgtaagtaacgttacctttaacctttacgtacgtaacgtacgtactccgtaacccgttacggaaccgaacggaaccacgtaacgtaggtaacgtaaacgtaacgtaggtggacgtctacgacctacagttccgtgttcttacccg

SEQ ID NO: 171024 - DNA, 614 bp, Homo sapiens
  misc_feature: GYAE6OF01ALFBB.27.78.H01.1.454.CMB.1.raw
  modified_base (336)..(336): a, c, t, g, unknown or other
  misc_feature (336)..(336): n is a, c, g, or t
  modified_base (472)..(472): a, c, t, g, unknown or other
  misc_feature (472)..(472): n is a, c, g, or t
tcagagcgtcgtctcacgaccggtgctcgatttagtgtgagtagtttgggtttggggatctttaaaaggaggttctttctctgggatcgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcgccggccacgtcagagcgttggtagtagcttacactggtaccagcagaacgccgagtcagtcctaccaaagcctcctacatcaagtntcgccttcccagttccttcgtcgtacggggtcccctggtacggttcgaggtcggcgtaggttcggaattcggtagggacctacgtactttccaccctcaccctactcaactacgccgtacggaacgcgtagacgtntcgcctacgacctaaccttacttactagtaccatccgagtacgttacttaccgtttacctacgtaacgttcgtacttacccgtaccgttaccggaccgtaaacgggtacctacggtacgacggtaacgtaacgttaaaccgg

SEQ ID NO: 171025 - DNA, 749 bp, Homo sapiens
  misc_feature: GYAE6OF01CY9ZF.27.78.H01.1.454.CMB.1.raw
  modified_base (287)..(287): a, c, t, g, unknown or other
  misc_feature (287)..(287): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccaggggtgaattgtgctgactcagtctccagtactttcagtctgtgacctaccgaaaggagaaagtcaccatccacctggccggcagtcagagcgttggtagtagcttacactggtaccagcagagcaggtcagtcaccaaagctccncatacaagtatcgccttcccacgttccttcgtccgtaccggggttccccctacggtacggttcgaacggttcggccgtaaggttcgggaacttccggtacggggaacctaacgtactttttacccaccccttaccaaccctaacttacaaacgttacggacccgttagggaacgtaccgtagaaacgtcgtacgaccttacgaccttaaaccgtttagtttaaccgttcggtacctaacgtttaccgaacggttaaccgtttaaacccttttaacccgttttaacccgtaaacgttaaacgttacgtaaccttaacccgtaccccggtttaccgggaaacccggtaacggggaaccctaaccggtaacgtacggggtaaacgttaaacgtttaaaaccgggaacgtttacgggtacggttacccgtacggaaccctacccgtaacttccgttccgtttaccc

SEQ ID NO: 171026 - DNA, 605 bp, Homo sapiens
  misc_feature: GYAE6OF01AWF88.27.78.H01.1.454.CMB.1.raw
  modified_base (521)..(521): a, c, t, g, unknown or other
  misc_feature (521)..(521): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactaccaaaggagaaagtcaccatccacctgccgggccagtcagagcgttggtagtagcttacacgtggtaccagcagaagccaggtcacgtctccaaagcctcctcatcaagttatcgtccttacccgagttcccttcgtccgtaccgggggttccccctacgggtacggttccaggtcggaccgtaggtcgggatcggtagggaacctactacgtttcccaacccctccaaccctataccaaacgtacgaccgtaggaacgtacgtaggaagtagtacgactacgtacgttaacttattacctgtactatacgagtacttaccttacttactanagtgtactcctaccgtcgaccgaaggacacgacgtaggaacgtaagtaacgacgttggacgctcgaccacgtattctgtctacg

SEQ ID NO: 171027 - DNA, 750 bp, Homo sapiens
  misc_feature: GYAE6OF01B02MU.27.78.H01.1.454.CMB.1.raw
  modified_base (306)..(306): a, c, t, g, unknown or other
  misc_feature (306)..(306): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaattgtgctgactcagtctccagactttcagtctgtgactaccgaaaggagaagtcaccactcacctcggccgggccagtcgagagtcgttaggtagtagctacacgtggtaccagacaagaacgccgaggtacacgtactaccaaacgtcctcctnactacgaagtactcgtaccttcccagttcccttacgtccgaccgggtccctacggtacggtaccgtaggtcggacgaggtggtacgtcggtacggactaccgttactttacccaaccctcctaacccgtacttaaccaaacgtaccggtacgttacgggaagtccgtaaggtaacgtacgttacggcttaaccggtaactttaaaacccgttttagttaacctttcggtaaccttaacgtaccgttaagttaaccgtttacctttaacccgtttaacctaacgtaacgttaccgtacgtaccccggtttaacccgttacccgggaaccggtaaaccggacgtaaccgttaacggtaaacggtaaacgttaaacgttaaaaccggtacggttcggtacgtacctacggtaccctacgtaccgtttccgtacgtttaccttacccg

SEQ ID NO: 171028 - DNA, 560 bp, Homo sapiens
  misc_feature: GYAE6OF01D6GA9.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaaagtatgcttcccagtccttcgtcgacggggtcccctcgtaggttcgagtggcaggtggatcgtagggacactattccaccctcaacctatacaatacgcctaggaagtctagaagtatgtctacgacgtaactttatacgtagtcatcgaagtacgtacttactttacctacgaagtcactactaccgttacgaccgaaaggtaccaacggtactacggaagtaagttaaaacgg

SEQ ID NO: 171029 - DNA, 775 bp, Homo sapiens
  misc_feature: GYAE6OF01CEHSG.27.78.H01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtgaaattgtgctgactcagtctcagactttcagtctgtgactaccgaaaggagaaacgtcaccatccaccgtcggccgggccagtcgagngtcggttaggtagtagtcttacacgtggtaaccagacagaagccaggtcacgtcctaccaaagcctacctcactacaagtactcgcctttccacgttcctttcgtcggtaccggggttcccctcggtaacggttcgaacgggtcggaccgtaaggtggtaacgttcgggtacgggaaacctaccgtaacctttcccaaccccttaccaaaccctaattacctaaaacggtaccggtaccgttacgggaacggtacggttaagaacgtacgtacgtactacggtaacctaaacgtttattaacttcggtacctaacggttacctaaggtaacgtttaacccgtttaacttttaacccgtaataacggttaccgttaaccttacccggtaacccgttaccggggaacccgtaaacgggtaccgaacggtaaccggtaacgggtaaacgttaaaaccggttaaaacccggacggttacggttacggtaacccgttacggaacccttaacccggttactttccgttacgttccccgttttaacccg

SEQ ID NO: 171030 - DNA, 550 bp, Homo sapiens
  misc_feature: GYAE6OF01BENS6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgaggttcagtggcagtggatcgtgggacacgtatttccaccctcaccatcaatagcctggaagctgaagatgctgactaacttattactgtacatcagtacgtaccttactttacctactaagtcgtactctaccgttcggaccctaagggaccaacggacgtagggaagtaacgtttaaacgaacgttggtacggactacgacccactattccttgttccttaccg

SEQ ID NO: 171031 - DNA, 619 bp, Homo sapiens
  misc_feature: GYAE6OF01CGDG9.27.78.H01.1.454.CMB.1.raw
  modified_base (306)..(306): a, c, t, g, unknown or other
  misc_feature (306)..(306): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggccagtcagagcgttggtagtagcttacactggtaccagcagaagccaggtcagtcnccaaagcctcctcatacaagtatgccttcccagttccttctcgacggggttccccctcggtacggttcaggtcggcaggtggacgtcgtagggacacgtactttaccaccctcaacctatacaatacgaccgtaggaagtccgtaggaagatacgtactagacctaaactttacgttacttcgtactactacgagtaacgttacttaacctttaaccgtacgtaaaggttcgtaacttaccgtacccgttacccggaacccgtaaacgggaccgtaacgaacgttaacgggaaagttaacgttaaaaacccgg

SEQ ID NO: 171032 - DNA, 555 bp, Homo sapiens
  misc_feature: GYAE6OF01BCO9F.27.78.H01.1.454.CMB.1.raw
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctaccaaagcctcctcatcaagtatgccttccacgttccttctcgcggggtcccctcgtaggttcagtcgcaggtgattcgngggacactactttccaccctcacccataccaatacgcctaggaacncgtagaagctgctgacctaacttatactntcatctagacttactactttacctactagtcgacttaccaccgttaccggacgaaacgggtaccacgtaagtaggtaacgtaagttaaaaccgg

SEQ ID NO: 171033 - DNA, 577 bp, Homo sapiens
  misc_feature: GYAE6OF01AU24C.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagttcccttctccgacggggtccccctcgacggttcaggtggcagtggatcgtgggacactactttcacccctcacccataccaatacgccctaggaacgctagaagatgcctgacctaactttattacttcgtactatcaagtacgttaacttacctttacctataacgttcgattcctacccgttcgggacccgtaaagggaccctacggaacgtcggtaagtaacgttaaaaccggg

SEQ ID NO: 171034 - DNA, 589 bp, Homo sapiens
  misc_feature: GYAE6OF01EZ187.27.78.H01.1.454.CMB.1.raw
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggtccagcctccaggggtgaaattgtgctgactcagtctccagactttcagtctgtgactccaaaggagaaagtcaccatcaccgtgccggccagtcagagcgttggtagtagcttacactggtaccagacnagacgcgagagtctacgtactacctaactcctacctactaactactagtactccgtccttcctctcctcgtccgtccggtccgtcgtacgtcgtcgtgcgngtcgtgtcgacgactactacctacctaccctacctactactacacgtacgtacgacgacgtagtagagtatcgtactactactaacttacttactactactactacgtacgtacttaccttaccttaaccgtacgtaagtacgtacctaccgtacccgtaccggtaaccggacggaaccgacgtacgtaaggtaacg

SEQ ID NO: 171035 - DNA, 568 bp, Homo sapiens
  misc_feature: GYAE6OF01D191B.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctcagtactttcagtctgtgactcaaagganaaagtcacatcactgccggcagtcagagtcgttggtagtagcttacactggaccagcagaagcaggtcagtctaccaaagctcctcactcaagtatagtcttcccagtccttctcgtacgggtcccctcgacgttcgaacggtgcgagtggaatcgtagggacacgtactttccgaccttcaaccatacaaagtacgacctggaagtctagaacgtagtcgactagacctaaacttattacttagtactaatcgaagtaacgtactaactttaccactaagtcgtaatacctaacgttccgacgaaggacacgtactaggaagtaaacgttaaacgaacgttggacgtctagtaccacatctcgttcttaccg

SEQ ID NO: 171036 - DNA, 604 bp, Homo sapiens
  misc_feature: GYAE6OF01BVHUF.27.78.H01.1.454.CMB.1.raw
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatccacctgccgggcagtcagagcgttggtagtagcttacactggtaccagcagaagccaggtcagtctccaaagcctcctcatccaaggtatcgtccttacccagttcccttcgtccacgggggttccccctcggtaggttccgaggtggcgaggtggactcgtgggactactacgtttccaccctcaaccctacgtactaaatacgacccgtagggaacgtcgtagaagattcgctcgtaactaactttattacttgactagtcagttaacgtacttaacctttacctacgtaagtntactcctacccgttcggaccaacgggtacaacgaccgtagggaacgtaacgttaaacggaacgtggtacgcgtagtccaactattcgtgtccttaccg

SEQ ID NO: 171037 - DNA, 581 bp, Homo sapiens
  misc_feature: GYAE6OF01DQ2I7.27.78.H01.1.454.CMB.1.raw
  modified_base (179)..(179): a, c, t, g, unknown or other
  misc_feature (179)..(179): n is a, c, g, or t
  modified_base (410)..(410): a, c, t, g, unknown or other
  misc_feature (410)..(410): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagttctgtgactaccgaaaaggagaaacgtcaccatccacctggccgggccagtcagagcgttggtagtagtcttacactggtaccagcagaagccgaggtcacgtctaccaaagctcctacatcaagtatcgcttccctagttcccttcgtcgacgggtcccctggtacgttcgagtggcagtggatcgtggactactnttccaccctcactatacaatcgccgtaggaacgcgtaggaatatcgctagctaacttattactgtactatactagtacttaacttaccttacctagtaacgtctataccgtaccgtttccgggaaccgtaacgggacccacggtactacgggaagtaaacgttaaaaccgg

SEQ ID NO: 171038 - DNA, 841 bp, Homo sapiens
  misc_feature: GYAE6OF01C4D6J.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctcagtactttcagtctgtgactaccgaaaggagaaacgtcaccatcaccgtcggccgggccaggtcgagagtcggttggtagtagcttacacgtcggtacacgacgaagacgccgtaggtcagtacctaccaaagctctcatacaagtactcgtccttcccgtactccttcgtccgtaccgggtccccgtggtacgggttcaggtcggcgtacggtggtaacgtcgtacgggtaactacgtacctttccaaccctacacctatactaaacgtacggtaccgtaggaacgtacgtacggaaagtcgtaggtacctacggttaaccttaacgtttaacgtttaccgttacgttaccgtaacgttaccggtaaacgtttaacgtttaaaccccgtttaaccgttttaacccgtaacgttaaccggtttaacggttaaccgttaaccccggtttaaaccccggtttaacccgggggaacccgttaaaccggggggaaaacccgttaccccgggttaaaaccgggttaacggggtaaaaaccggtttaaaaccggtttaaaaaccgggttaaacgggtttccgggggttaacccgggtacccggttaacccggtaaacccccgttaaaccccgttacggttttaccccggttttccggttaaccccgtttttaaccccgg

SEQ ID NO: 171039 - DNA, 542 bp, Homo sapiens
  misc_feature: GYAE6OF01A8CHW.27.78.H01.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccggggccagtcagagcgttggtagtagctttacactggtaccagcagaagccaggtcagtctccaaagctcctcatcaagtatgcttcccagtccttctcaggggtcccctcgaggttcagtggcagtggatcngggacactatttccaccctcaccatcaatacgcctggaanctagaagatgctgctaacttattacctgtcatacagagtaccttactttaccctactaagtgtaatcctaccgttcggacccgaagggaccacggacgtagggaacgtaagttaaaccgaacgttgtggaccttcgcacccatctgttcttccg

SEQ ID NO: 171040 - DNA, 706 bp, Homo sapiens
  misc_feature: GYAE6OF01DIYO8.27.78.H01.1.454.CMB.1.raw
tcagagcgtcgtctcacgaccggtgctcgatttagtgtgagtagtttgggtttgggggcgatagagaccaaactgacaagtcaaggcaggaagatgttgccatcacaactcattgggtttctgctgctcgtgggttccagcctccgagggtgtaattgtgctgactcagtctccagtactttcgagtctgtcgacgtacgaaaggacgaaagtcaccatacgacgtcggccggcagtacagtagtcggttagtagtagtacgttacacgtcggtaccagacgagacgcgaggtaccgagtaccacgaaacgcctcgtacagtacgtaaagtctcgaccttccacgttaccctttcgccgtaccgggtcccctaggtaggtacaggtcgacgacggttagacgttcggtaggaactactacgtttaccaccctacaactacgtactaaacgtacgcccgtaagggaaagtccgtaaggaactacgttacgaacgtagtaaacccttaagtttaacttaccggttacgtacctagttaccaagggttaacctttaacccgtttaacgtaaccctagtaaaccggttcgttaactaccgttaccgttaaccgggacccgtaaaggggtacccaaggtacgtaacggaacgttaaagtaaacgaccgtttgtaacggcctacgaacctactacgttcccgtgtttacccg

SEQ ID NO: 171041 - DNA, 710 bp, Homo sapiens
  misc_feature: GYAE6OF01C2J35.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcacatcacctgccgggcagtcagagcgttggtagtagcttacacgtggtaccagcagaagcgaggtcaggtctaccaaagcctacctcatacaagtactcgtccttcccacgttcctttcgtccgtacgggttcccctcggtacggttccgaggttggcgtaggtcggaatcggtagggaactactacgtttcccaacccttacaaccctatacctaaagtacgcccgttagggaacgtccgtaagaaacgtcgtacgtacctaggtaacccttaaacttttacttaaccgttacggttacctaaacgttaccgtaagttaacgtttaaacccctttaaccttttaacccaacgttaaacgttacggtaacctttaacccgtacccgtttaccgggaacccgtaaaacggggtacctaaccggtaaccggtagggtaaaccgtaaagttaaaacccgaaggttcggtacggacttacggacctacctagttccttacgtctttacccg

SEQ ID NO: 171042 - DNA, 582 bp, Homo sapiens
  misc_feature: GYAE6OF01EU08N.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacactatttcaccctcaccatcaatacgcctggaacgctagaagatgctgactaactttattactgtcatcgaagtacgttaccttaactttacctacgtaagttcgtaattcctaccgtttccggacccgaaacgggaccaaccggtaacgtagggtaacgtaaacgtttaaaaccggaacgttggtacggtactacggaccctaaccctattccgttcgttctttacccg

SEQ ID NO: 171043 - DNA, 662 bp, Homo sapiens
  misc_feature: GYAE6OF01C5LTJ.27.78.H01.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (323)..(323): a, c, t, g, unknown or other
  misc_feature (323)..(323): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagactttcagtctgngactccaaagganaagtcaccatcacctgccggccagtcagagtcgttggtagtagcttaacactaggtaccagccaagaagccaggtcagtcctacaaacgctccncactacaagtatcgccttacccagttcccttacgtccgtaccgggggttcccctcggtaaccgggttctaacgggtcggtcctaagggtcggtacgttccgtaggggtaaccacgttacttttcccgaaccccttacgaacctactacctaaagtacggtaccctagggaaacgtcgtagaagtactcggtactagtaacctaactttaagtttactgtaccaagttccaagtaacgttaacctttacttaaccctagtaacgttcgtattacccgtaccgttaccgggaaccgaaacgggtactaacggaattaggggaactaaacggttaaaaccgg

SEQ ID NO: 171044 - DNA, 719 bp, Homo sapiens
  misc_feature: GYAE6OF01C5M08.27.78.H01.1.454.CMB.1.raw
  modified_base (204)..(204): a, c, t, g, unknown or other
  misc_feature (204)..(204): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtcgactaccgaaagganaaagtcaccatccaccgtcggccggccagtcaggacggtcggttagggtaacgtagtaccttaacgtaccgttacgggtaaccagacgaacggaacgaccgaggtccacgtacctaccaaacgcctacctactaactacgtaaagttctaccgtcccttacccgtacgtttcccttacgtacccggtaccggggtcccctacggtacgggttctaggtcggacgtaggtcggactcggtagggtaacctacttaccttaccctaccctacaacctatactaacgtaccgaccgtaggacgtacgagaaacggtntacgtacgtagtaaccttaacgtttactacctgtactacgtacctaagtaacgtttaacctttaaccttacctaacgtaacgttacgtacttcccgtaaccggttacggaaccgacgggtaacacccggtaagtagggaaaccgttaaagtaaccgtcgtacggaccgtacgtaccgaccgtaactcttcgttcttacccg

SEQ ID NO: 171045 - DNA, 881 bp, Homo sapiens
  misc_feature: GYAE6OF01C0SIW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgaggggtgaaattgtgctgactcagtctccagtactttcagtctgtcgactaccgaaaggagaaagtcaccatccaccgtcggccgggccacgtcgagaggtcggtttaggtagtacgtacttacacgtacggtaccagacaagaaggccgaggtcacgtctaccaaagcctcctacactacaagtatcgtccttaccctacgttcccgtttaccgtaccggtaacccgggggttcccccttaccggtacgggttttaccgacgggttacgggaccgtaacgggttacgggtaacgttcggtaaccgggggttaacctaaacccgttacctttttaccccgaaacccccttaccctaaaacccctaactttaaacccgtaaaacggttaccgggtaaccccggttaggggaaaccgtaccgggtttaaggaaacgggtacgttacggtaccgttaacgttaacccgtttaaaacttttaaccgtttaaccgttacggtaacccttaaagttacccgtaaagggtttaaacgtttaaaccccgttttaacccttttaaacccgtaacgttaaaccggttacgtaaccctttaacccgttacccggttaccgggaacccggtaaacggggtaacccgaaccggtacgtaaaggggaaaccttaaacggttaaaaccggtacggtacggttacgggtacctaccgtacccgtaaaccttagtaccgtttccgttacgtttaccccg

SEQ ID NO: 171046 - DNA, 657 bp, Homo sapiens
  misc_feature: GYAE6OF01AY0D4.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccgggccagtcagagcgttggtagtacgcttacacgtcggtaccagcagaacgccaggtcagtcctaccaaagcctacctcatacaagtatcgtccttccctagttcccttctccgacggggttcccctacggtacggttcaggtggcgaggtggatcgtacgggacactactttccaccctacacctactacaatacgccgtaggaacgcgtagaagtatgtctagactaactttaattacgtagttaccaagtacctaaggtaacgttaaccgttacctttaaccctaccgtaaagttacgaaccttacccgtaacccgttacccgggaaccggtaacgggtaaccaacgggtaaccgtacgggtaaacgtaaagtttaaaacccggaacgttacggttacggacgtacgacccgtaacctattccgttgtttacccg

SEQ ID NO: 171047 - DNA, 643 bp, Homo sapiens
  misc_feature: GYAE6OF01C1XTP.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtgaaattgtgctgactcagtctccagactttcagtctgtgactaccaaagganaaagtcaccatcacctgccgggcagtcagagcgttggatagcttacacgtggtaccagcaagagccaggtcagtactccaaagctcctcatacgaagtatcgccttcccagttccttctcgacggtccctcgtacggttcagtggcaggtgatcgaggactactattaccaccctacacctatactaagtacgccgtaggaagtctagaacgtagtacgctacgtaacctaaactttaacttaccgtaggtacctaataccgaagttaagttaacccttaactttttaaccgaacgtaagttaacgtaacttacccgtaccgttacccgggtaacgaaaccggggaactaaccggaacgttaagggaaaccgtaaacgttaaaaccgaacgttggttaaccggcgttaccgacctaaaccgtattaccgttcgtaccctttaacccg

SEQ ID NO: 171048 - DNA, 558 bp, Homo sapiens
  misc_feature: GYAE6OF01DV6BH.27.78.H01.1.454.CMB.1.raw
  modified_base (340)..(340): a, c, t, g, unknown or other
  misc_feature (340)..(340): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaacgccaggtcagtctaccaaacgctcctcatcaagtatgcttccacgtccttctcgacgggtcccctcgtgtcgagtgcngtgatctggacactattccaccctcaccatacaactagcctaggaacgctagaagtatgctagactaacttatactgtactactcacgtacgttaaccttactttacctatagttacgtactcctaccgttacggacaacgggtaccaacggtactaggaacgtaacttaaacgacgtggtacggcttacggctaaccgtatttacctgttccttacg

SEQ ID NO: 171049 - DNA, 725 bp, Homo sapiens
  misc_feature: GYAE6OF01CWK7A.27.78.H01.1.454.CMB.1.raw
  modified_base (149)..(149): a, c, t, g, unknown or other
  misc_feature (149)..(149): n is a, c, g, or t
  modified_base (323)..(323): a, c, t, g, unknown or other
  misc_feature (323)..(323): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactaccgaaaggagaaagtcaccatcacctggccgggccagtcagagtcgttggtagtagcttacacgtggtaccagacagaacgcaggtcagtcctacaagctcctcatacaagtatcgtcctcccagtccttcncgtaccgggtccctgtagttcgaggtggcgtaggtggtaagtcgtacgggactaacgtctttaccaccctcaacctatacaacgtacgtcctagggaactaccgtaggaaacgtnttacgacgtaacgtaccttaaacttttaaccgttacgtgttaaccagttaccgtaacgtaaccgtttaactttaaccctttaacctaacgtaacggttacgtaaccgttacccgttaacccgttaccgggaacccgtaaacggggtaaccctaaacccgggttaacgtaacggggtaaaaccgttaaaacggtttaaaaacccgggtaaccggtttacgggttaacgggtcccgttaaacggtacccctaaacccggttacccttacggttcccggttttaaacccc

SEQ ID NO: 171050 - DNA, 774 bp, Homo sapiens
  misc_feature: GYAE6OF01DK3GR.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttggggtttggggggcatgagcaaaactgacaagtcaaggcaggaagatgttgccatcacaactcattgggtttctgctgctctgggttccagcctcgaggggtnaattgtgctgactcagtcctccagtactttcagtctgtcgactaccgaaaggagaaacgtcaccatccaccgtcggcccggctagtacaggtacgtcggttaggtaacgtacgtaccttaacgtaccgtacggtaaccagacgaacggaacgaccgtaacgggtccaacgtaccgtaccaaacgccttacctactaacgtacgaaagttactcggtaccctttcccgtacggtttcccttacgtaccgggtaccggggtccccctaggtacggttcgacggttcggacgtagtacggtacgtcggtacggaactactacttacccacccttacaccgtatactaagtacgaccgttaaggaactcgtaaggtaacgtacgttacggacttacgtaacctttaaactttacgtttaacgtacgttactacgttacgtaacggttaacctttaaccctttaacctttaacgtaccgtaacgttacgaccttacccgtacccggttaccggaaccgtaacgggtaaacccgacgtaacggttaacgggtaaacgtaaacgtttaaacggacggttcgggtaccgtacgtaaccggtaccaaccgttacgttccgttacgtttacccg

SEQ ID NO: 171051 - DNA, 700 bp, Homo sapiens
  misc_feature: GYAE6OF01CTA86.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactccaaaggagaaagtcaccatccacctggccgggccagtcagagtcgttggtagtagcttacacgtggtaccagcagaacgccaggtcagtctaccaaagcctcctcatcaagtatcgccttcccacgttccttcgtccgacggggtcccctggtaggttcaggtggccaggtggactcgtaggactactacgtttccaaccctcaacctatacaaactacgccgttagggaacgtccgtaaggaacgtacgtcgtacttacggtaaccttaaacgttttactttaaccgttcgttactactaccgtaaacggttacgtttaacctttaacccgtttttaacccgtacgttaaacgggtttcgtaaccgtttacccgtaaccccggtttaccgggaccgtaaacggggtaccgtaaccggtaacggtacggtaaacgtaaacgttaaaccggtaacgttcgggtacgtaccgttacgtacccgtaacctagttccgttcgttccgtttacccg

SEQ ID NO: 171052 - DNA, 845 bp, Homo sapiens
  misc_feature: GYAE6OF01EDS11.27.78.H01.1.454.CMB.1.raw
  modified_base (153)..(153): a, c, t, g, unknown or other
  misc_feature (153)..(153): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcgagggtgaattgngctgactcagtctccagtacttcagtctgtcgactaccgaaaaggagtaaacgtccaaccatccgaccgtcggcccgggaccagtcgaagaggtcggtttagggtagtacgtccttaacgacgttcggtaccagcaagaacgccgtaggtctaacgtccaaccgaaacgtcctcctacactacgtaaagttctccgtccttacccgacgtttccttccgtaccgggtacccgggttcccctaggttaacggttcgaacggtcggacgtaggtacggtacttcggtacggaacctaaccgttacttacccaccccgtacctaactacgtaactaacggttaccgtacccgttaaggaaccgtacgttaacggtaaacgtcttaccggtacgttacgtaaaccttttaaaccgtttacgtttacgtacgttacctaacggttacgttaaacgggtttaacctttaaacccgttttaacccgttttaacccgtaaacgttaacggttaacccgttaacccttacccggttaaccccgggttacccgggaaaccggtaaaccgggtaacccgtacggtaaaccggttaacggttaaaccggttaaaaacccgttaaacgggttacccgttacggggtaccgttaaccggtaccgttaacccgtaacctttacgttccgttacccgttttaaccccg

SEQ ID NO: 171053 - DNA, 557 bp, Homo sapiens
  misc_feature: GYAE6OF01EBZL2.27.78.H01.1.454.CMB.1.raw
  modified_base (315)..(315): a, c, t, g, unknown or other
  misc_feature (315)..(315): n is a, c, g, or t
  modified_base (451)..(451): a, c, t, g, unknown or other
  misc_feature (451)..(451): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagcagaagccaggtcagtctccaaagctcctcatcaagtatgccttccagtccttctcgngggtcccctcgtagtcagtggcagtggatcgtgggacactattccaccctcaccatcaatacgcctggaatctagaagatgctagactaacttacttactgtctactcagtacgttactacttacctactaacgtntactacctaccgttacggaccaagggaccaacggtacgtaggaacgtaacgttaaacgaacgttggtacggtacgtcgtacctacctattccgtgttccttacccg

SEQ ID NO: 171054 - DNA, 535 bp, Homo sapiens
  misc_feature: GYAE6OF01BZSCB.27.78.H01.1.454.CMB.1.raw
  modified_base (87)..(87): a, c, t, g, unknown or other
  misc_feature (87)..(87): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatcttaaaagaggttctttctctgggatgnggcatgagcaaaactgacaagtcaaggcaggaagatgttgccatcacaactcattgggtttctgctgctctgggttccagcctccaggggttaaattgtgctgactcagtctccagactttcagtctgtgactccaaaggagaaagtcaccatcacctgccggcagtcagagcgttggtagtagcttacactggtaccagcagaacgccaggtcagtctccaaagctcctcatcaagtatcgcttcccagttcccttctcgacggggtcccctcggtacggttcaggtggcaggtggatcgtgggactacgtatttccaccctcaccatcaatcgcctaggaagctagaagatgctgactaacgtttattactgtcatcagtactactacttacncaagtgactcaccgttcgaccaaggacacgactaggactaagtaaacgtaacg

SEQ ID NO: 171055 - DNA, 756 bp, Homo sapiens
  misc_feature: GYAE6OF01BZ3DZ.27.78.H01.1.454.CMB.1.raw
tcagagcgtcgtctcacgaccggtgctcgatttagtgtgagtagtttgggtttggggggcatgagcaaaactgacaagtcaaggcaggaagatgtgccatcacaactcattgggtttctgctgctctgggttccagcctcgaggggtgaaattgtgctgactcagtcctcagtactttcagtctgtacgactacgaaaggtagaatcaccatccaccgtcggccgggcagtcaggagtcggttaggtagtacgtacttacgacgttacggaccagacgaagaacgcgaggtcacgtacctaccgaacgtcctacctactaatactaagtactcgtacccttccctacgttccctttaccgtaccgggtaccgggttccccgtcggttacggttaccgagggttcggacgtaggttacggacgttacggtacgggaacttaccgtacctttacccgaacccctttaccaaaccttacgtaaccgtaacggttaaccggtaccggttaagggtaaacgtaccgtaaggaacggtacgttacggaccgttaacgtaacctttaacgttttaacttaccgttacgttacctaacgtacgtaaacgttaaccgtttaacctttaaccgttaacctacgtaacgtagtaacctaccgttacccgtacggaaccgaagggacctacggtaacgtaaggtaacgtaaacgttaagtacggttggtacgtaactaccggacttaaccgtcttccgttcgttaccc

SEQ ID NO: 171056 - DNA, 605 bp, Homo sapiens
  misc_feature: GYAE6OF01D1YVT.27.78.H01.1.454.CMB.1.raw
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtacttttcagtctgtgactccaaaggagaaaagtcaccatccacctgccgggccagtcagagcgttggtagtagcttacactggtaccagcagaagccaggtcagtctaccaaagctcctcatcaagtatcgcttcccagtccttctcgacgggtcccctgaggttcagtggcagtggatcgtgggacactactttccaccctcaccatacaatacgcctaggaanctagaagatgntagactaacttattactgtactattacaagtacgttaaccttaactttaaccctacgtaagttcgtaacttaccgttacccgttaccgggaccgtaaacggggacctaaccgaccgtaagggtaaacgtaacgttaaaacggacgttgggtaccggtacctacggacccaacctagttacccttgttccctttaaccg

SEQ ID NO: 171057 - DNA, 523 bp, Homo sapiens
  misc_feature: GYAE6OF01ER4RD.27.78.H01.1.454.CMB.1.raw
  modified_base (230)..(230): a, c, t, g, unknown or other
  misc_feature (230)..(230): n is a, c, g, or t
  modified_base (372)..(372): a, c, t, g, unknown or other
  misc_feature (372)..(372): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctccaaagctcctcatcaagtatgcttccagtccttctcgacgggtcccctggacggttcagtggcnggtgatcgtgggacactactttcaccctcaccatcaatacgctggaagctagagatgctgctaacttatactgtacatcagtatacttactttaccatagtctatctacctcggaccaacgggtacacgactggaagtaagttaaaaccgg

SEQ ID NO: 171058 - DNA, 567 bp, Homo sapiens
  misc_feature: GYAE6OF01AV9VA.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgccttccagtccttctcgacgggtcccctcgtaggtcaggtgctaggtgagtcgtagggacctacgtactttccaccctcacccaatacaatacgcctaggaagtccgtagaatacgtcgtactcgtactaacttattacgtgtactatacgagtacgtacttaaccttacctacgtaagttcgactctacccgttaccgaccgaacggacacgacgtaggaacgtaattaaaccgg

SEQ ID NO: 171059 - DNA, 586 bp, Homo sapiens
  misc_feature: GYAE6OF01EQZP0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgagggtcccctcgaggttcagtggcagtggatctgggacactattcaccctcaccatcaaatacgcctaggaatctagaagatgctagactaactttattactgtcgatcaagtaacgttacttactttaacctataacgtgtacttacctacccgtttccgggaccgtaaacggggaccaaccggtaccgtagggtaacgtaaacgttaaaacggaacgttcgggtacggacgttacggaccaacccgtaattccgttagtccgtttaacccg

SEQ ID NO: 171060 - DNA, 565 bp, Homo sapiens
  misc_feature: GYAE6OF01D1C6U.27.78.H01.1.454.CMB.1.raw
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtccaccatccacctcgccggccagtcagagcgttggtagtagcttacactggtaccagcagaagccaggtcagtctaccaaagctcctcactacaagtatcgcttccctacgttccttctcgtacggggtcccctcggacggttcagtcggcaggtggatcgngggtacactacttccaccctcaccatacaatacgcctggaacncgtagaagtntgctgactaacttattactgtcatacacgtacgtacttacttacctatagtcgtatccaccgttccggaaccgaacgggaccacggtagtacgggagtaagttaaaacccgg

SEQ ID NO: 171061 - DNA, 510 bp, Homo sapiens
  misc_feature: GYAE6OF01BMPYF.27.78.H01.1.454.CMB.1.raw
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgagttcagtggcagtggatctgggacacatttcaccctcaccatcaatacgcctggaacgtctagaagatgctgactaactttattactgtcatcagtagtacttactttacctacagtgatcaccttcggaccgaaggacacgacgaggagtattaacgactcgnggctcgcacctatctgtctc

SEQ ID NO: 171062 - DNA, 586 bp, Homo sapiens
  misc_feature: GYAE6OF01CG0GR.27.78.H01.1.454.CMB.1.raw
  modified_base (300)..(300): a, c, t, g, unknown or other
  misc_feature (300)..(300): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaagtcaccatccaccgtgccggccagtcagagcgttggtagtagcttacacgtggtaccagcagaagccaggtcagtctaccaagcctcctcatcaagtntcgccttcccacgttccttcgtccgtaccggggtcccctcggtaggttcaggtcggacgaggtggacttcgtaggacactcttccaccctacaccctatacaatacgccgtaggaacgcgtagaagtatacgtctcgactaacttacttactgtacatcagtacttaacttacttacctactaagtcgtactaccgtaccgtaccgaccgaagggacctacggtacgtaggtaacgtaagttaaacggtcgtagtacggctacgacctaccgtattcgtcgttacc

SEQ ID NO: 171063 - DNA, 562 bp, Homo sapiens
  misc_feature: GYAE6OF01BK87Z.27.78.H01.1.454.CMB.1.raw
  modified_base (149)..(149): a, c, t, g, unknown or other
  misc_feature (149)..(149): n is a, c, g, or t
  modified_base (179)..(179): a, c, t, g, unknown or other
  misc_feature (179)..(179): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (272)..(272): a, c, t, g, unknown or other
  misc_feature (272)..(272): n is a, c, g, or t
  modified_base (457)..(457): a, c, t, g, unknown or other
  misc_feature (457)..(457): n is a, c, g, or t
  modified_base (550)..(562): a, c, t, g, unknown or other
  misc_feature (550)..(562): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttcngctgctctgggttccagcctccgaggggtnaaattgtgctgactcacgtcctccagtacctttnacgtctgtcgactaccgaaagganaaagtcaaccatccactcggccggccagtcaacgngtcggttaggtagtacgtaccttacgtaccgtacggtaaccaggacaaggaacgcctaggttaccaacgtccctaaccgaaacgtcctacctactaataccgtaagttactccggcctttaccccgacgtttcccttacgtccggtacccggggtccctaggtacggttcaaggttcgcgtaagngtacgtcgtacggactactacctttccacccgttaccacctactaactaacgtacgtaccggtagaacgtacgttacggaacgtagttaccgnnnnnnnnnnnnn

SEQ ID NO: 171064 - DNA, 736 bp, Homo sapiens
  misc_feature: GYAE6OF01BYD5T.27.78.H01.1.454.CMB.1.raw
  modified_base (723)..(723): a, c, t, g, unknown or other
  misc_feature (723)..(723): n is a, c, g, or t
tcagagcgtcgtctcacgaccggtgctcgatttagtgtgagtagtttgggtttggggatgagcaaaactgacaagtcaaggcaggaagatgttgccactcacaactcattgggtttctgctgctctgggttccagcctccaggggtgaaattgtgctgactcagtctccagtactttcagtctgtgactaccaaaggagaaagtcaccatccacctgccgggccagtcagagcgttggtagtagcttacactcggtaccagcgagaacgccgaggtcagtcctaccgaaacgcctcctcatacaagtactcgtccttcccgtacgtttcccttccgtccggtaccggggttcccccgtacggtacggttcgtaggtcggacgtaggttcggtaacgtcggtacggggacctaaccgtaccgttttacccaccccttacctaacccgtataccgtaaacgttacggtacccgttagggaaacgtccgtaaggtaaacggtattaccgacgttacgtaaccttaaacgttttactttaacgttacgtactaactacgtaaacggttaacgttaacctttaccgtttaacctacgtaacgttacgtacttacccgtacccgttacgggtaccgaaacgggaaccgacggtaccgtagggtaacgtaacgtttaaaccggtaacgtacggttcggtacgttaccgacctaacccgttattaccgttnttacccgttaccg

SEQ ID NO: 171065 - DNA, 612 bp, Homo sapiens
  misc_feature: GYAE6OF01D12AL.27.78.H01.1.454.CMB.1.raw
  modified_base (230)..(230): a, c, t, g, unknown or other
  misc_feature (230)..(230): n is a, c, g, or t
  modified_base (465)..(465): a, c, t, g, unknown or other
  misc_feature (465)..(465): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtcctccagtactttcagtctgtgactcaaagganaaagtcaccatccactcgccggccagtcagagtcgttaggtagtagcttacacgtgtaccagcagagccaggtcagtctaccaaagcctctacatcaagtactcgccttcccagttccctttccgtcgaaccggggttcccctaggtacggttccaaggtcggactaggtcgaatcgtagggactacgtactttccacccttacaccatacaatcgccgtagaactcgtagaacngttcgactagacccttaagttacttaaccttgtaccactcagttaaccgtacttaaccttacctaagtaacgttacgtaacttcctaaccggttaccggaccgtaaacgggaccaacgtacgttaacggaagtaacgttaaaaccgg

SEQ ID NO: 171066 - DNA, 546 bp, Homo sapiens
  misc_feature: GYAE6OF01BAJF8.27.78.H01.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (327)..(327): a, c, t, g, unknown or other
  misc_feature (327)..(327): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtnaaattgtgctgactcagtctccagactttcagtctgtgactccaaaagganaaagtcaccatcacctgccgggccagtcagagcgttggatagcttacactggtaccagcagaagccaggtcagtctccaaagctcctcatcaagtatgcttccagtccttctcacggggtcccctcgnggttcagtggcagtggactcgtgggacacactttcccaccctcaaccatcaatacgcctagggaacncgtagaacgatcgctgacctaactttacttactgtcatcagtacgtactactttactcaagtgactcaccgttcggaccacgggacaaccgacgtggtaagtacttaaaccggcttacggtcggacctcggaccaccgtactccgtgttccc

SEQ ID NO: 171067 - DNA, 709 bp, Homo sapiens
  misc_feature: GYAE6OF01CRE3S.27.78.H01.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgagggtanaattgngctgactcagtctacctagtacttcagtctgtagtacctaccgaaaggtaagaaacgtacaaccactccgaaccgtcgggccgggacctagtacgacggtacggtcggtttaggtaaggtacgtaccttaacgtacgtacggtacgagtacgaaggaaccggccgagggttcacgtcctaccaaacgtcctacctacatacaacgttactcgtccttcctacgttccttacgtacggtaccgggttccctacggtacggttcgtacggtcggacgtaggtcgtactcgtaggacctactaaccttccgaccctacgtacctaactacaaagtcgtacgtaacggacgtacgtagaacgtattaccgacgtacgtaacttaactttacgttacgtacgttactactacgtaagtaaccttactttaaccttaacgtacgtaaacgtcgtaccgttaacctcgtttacccgggaaccgtaaagggtaccctaaggtaacgtacggtaaacgttaaacgtaaacgg

SEQ ID NO: 171068 - DNA, 690 bp, Homo sapiens
  misc_feature: GYAE6OF01CPP71.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtgactacgaaaggagaaacgtcaccataccaccgtcggccggccagtcaggtagtcggttaggtagtacgcttacacgtacggtacagacgaggaacgacgaggtcacgtactaccgaaagcctaccactactacgtaagtactcgtcctaccgtacgttccttcgtaccggtacgggttcccctacggtacggttcgaggtacggacgaggtacggtacgtacgtacgggtacctacttacttacccaacctaccaactactacgtaatacgtccgtaggacgtacgtaggaacgtagtacggtactacgaacttaacttactttactacgtactaacgtacgtaacgtaaccgttactttaacctttaacctaccgttaagtaccgtacgtaccgttacccgtaccgggaacgaaccgtaccggaacgtacggtaggaaacgtaacttaaacggtacgtacggtcgtaccgttacgacgaccttacggtcttcgttacccg

SEQ ID NO: 171069 - DNA, 685 bp, Homo sapiens
  misc_feature: GYAE6OF01ETCDI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctggccgggccagtcagagcgttggtagtagtcttaacactggtaccagacaagaacgccaggtcagtacctaccaaagcctcctacaatcaagtatcgtccttccctacgttccttctccgacgggttcccctcgtacggttcgaggtcggactaggtggtagtcgtagggacaactactttaccacccttacacctatacaatacgcctaggacgtcgtagaagtacgtgacgtacgaccttaaactttacttacttacgtacgtaactacgtaagttaacgttaacctttaacctttaaccctaactaacggtacgtattacccgttaaccggttaccgggaacccgtaaacggggaacctaaaccgggtaccgtaaggggtaaacgtaaacggtttaaaacggtaaccgttcgggttaacggtacgttacgtacccgtaacccgtacgtttacccttcgttacctttacccg

SEQ ID NO: 171070 - DNA, 660 bp, Homo sapiens
  misc_feature: GYAE6OF01CEUP1.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (387)..(387): a, c, t, g, unknown or other
  misc_feature (387)..(387): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcagggtnaattgtgctgactcagtctccagactttcagtctgtgactccaaagganaaagtcaccatcacctgccggcagtcagagcgttggtatagcttacactggtaccagcagaagccaggtcagtctacaagctcctcatcaagtatcgtaccttcccagttccttcgacgtacgggtcccctggacggttcaggtcggctagtggtacgtcgtagggactacgtactttccacccttcaactntacaacgtacgtcctaggaagtcctaggaagtagtcgacgtagtactaactttattaaccttgtacctaattacgaagttaacgttaaccttaacccttttaacaccgttaacgtacgtaacgttaccgtaacccgttaccggaacccgtaaaggggtaacctaaaccgggtaaccgtacggggtaaacgtaaacgtttaaaacccggtaaggttcggtaacggggtacctaccggtaacccgtaacctaacgtttccgtaacggttttcccc

SEQ ID NO: 171071 - DNA, 680 bp, Homo sapiens
  misc_feature: GYAE6OF01ETV2A.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagactttcagtctgtgactccaaaaggagaaagtcaccatcacctgccgggcagtcagagtcgttggtagtagcttacactggtaccagcaagacgccaggtcagtctaccaaagcctcctcatcaagtactgccttcccagttccctttcgtccgtaccggggttcccctcggtaacggttcgaggttcgggactaggtggtacttcggtagggaacacgttactttcccacccctcaacctatacaatacgccgttagggaacgtctaggaaagtgtacgcctaggaaccttaaactttaacttaccgttacgttactaacgtacgtaacgtaacgtttaaccctttaacccttttaacacccgttaaaggttacgaactttccccgtaaacccgtttacccggggaacccgtaaaacgggggtacccaaaccgggtaacgttaacggggaaacgttaaacgtttaaaaacccgg

SEQ ID NO: 171072 - DNA, 548 bp, Homo sapiens
  misc_feature: GYAE6OF01BAUNY.27.78.H01.1.454.CMB.1.raw
  modified_base (397)..(397): a, c, t, g, unknown or other
  misc_feature (397)..(397): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaagtatgccttcccagtccttctcgacggggtcccctcggtaggttcagtggcgtagtggatcgtggacactactttcaccctcacctatacaatacgcctggaacnctagaagatgctgactaacttattactgtacatcagtactaacttacttaacctactaagtgtactacctaccgttacggaccgaagggaccacggacgtaggaacgtaattaaacggacgtggtacggctacgacacattctgtcttacc

SEQ ID NO: 171073 - DNA, 620 bp, Homo sapiens
  misc_feature: GYAE6OF01ESG6H.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccggcagtcagagcgttggtagtagcttacacgtggtaccagcaagaagccaggtcagtctaccaaaagctcctcaatcaagtatcgccttcccagttcccttctcgacggggtcccctcgtaggttcacggtggcaggtggatcgtgggacctacgtactttccgaccctcaaccatactaactacgtccgtagggaacgtcctaggaaagtatcgacgtagacctaaacgttttattacctggtacctactacgtaagtacgttaccttaacttttaccctacgtaagtcgtaacttaccgtacccgttccggaccgaaacgggtacaccgaacgttacgggaagtaacgttaaacggtaactggtacgccgtacgaccaaccgttactcgttgttacccg

SEQ ID NO: 171074 - DNA, 569 bp, Homo sapiens
  misc_feature: GYAE6OF01E2NZM.27.78.H01.1.454.CMB.1.raw
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagcctcctcatcaagtatcgccttccctacgtccttctccgacggggttccccctcggtacggttcaggtcggcgaggtggatcgtgggacacgtactttccaccctacaccatacaatacgccgtaggaacgtctagaagatgctggactaacttattactgtcagtcagtactacttacttacctanaagtnactccaccgttacggaccgaagggaccacgtacgtaggaacgtaacgttaaacgaacgttggtaggctacgtacctaccattctcgtcttacccg

SEQ ID NO: 171075 - DNA, 602 bp, Homo sapiens
  misc_feature: GYAE6OF01CNBW1.27.78.H01.1.454.CMB.1.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggtccagcctcgagggtgaaattgtgctgactcagtctccagtactttcagtctgtgactaccgaaagganaaaacgtcaccatcacctcggccgggccagtcagagtcgttggtatagcttacncgtagtacagcagaagccaggtcacgtctaccaaagcctcctacactacgaacgtattcgccttccacgtccttctccgacgggtcccctcgaggttcagtggcaggtgatcgtggactacgtacttccgaccctcaaccattacaatacgccgtaggaacgtcgtagaagtactgtctacgactaacttacgttactcgtacatcaagtacttaaccgttactttactacttaacgtctactaccgtaccgttcggtacgaacggactaacgtacgtaggaacgtaacgttaaacggacgttaggtcggtacctacggtacctaccggtattccgttcgttaccttaccg

SEQ ID NO: 171076 - DNA, 534 bp, Homo sapiens
  misc_feature: GYAE6OF01DZ5CW.27.78.H01.1.454.CMB.1.raw
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (521)..(521): a, c, t, g, unknown or other
  misc_feature (521)..(521): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcgagggtcccctcggagttcagtggcagtggatctgggacactatttccaccctcaccatacaaatacgcctggtagctagaagatgctgactaacttattactgtcatcagtacgttactactttacctnaagtntatccaccgttcggaccaacgggacacgacgtagggagtaacttaaacgacgttgacggctcggaccaacctntcgtgtcttaccg

SEQ ID NO: 171077 - DNA, 724 bp, Homo sapiens
  misc_feature: GYAE6OF01B8NOR.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaaggagaaagtcaaccatccacctcggccggaccagtcagagtcggttaggtagtagtcttacacgtcggtaccagcaagacggccaggtcacgtcctaccaaacgtcctacctacaactacgtaagtactcgtccttaccctacgttcccttaccgtccggtacccggggttccccgtacggtacggttccgtaggtcggtacgtaggtacggtacgttacggtacgggtaacctactacctttacccgaacccctctaaccctaactaacctaaacgtaaccggtcccgttaaggaacggtacgtaaggaacgtactacgtaccgtacgtaacctttaaacttaccgtttacgtacgttacacgttacgtaagtaaccgtttaacccttaaccgtttaaccaagttaacgtacgtaaccttacccgtcccggttaccgggaaccaacgggtacctaaccggtaggtaacggtaaacgtaaaccgttaaaccggg

SEQ ID NO: 171078 - DNA, 713 bp, Homo sapiens
  misc_feature: GYAE6OF01D17QB.27.78.H01.1.454.CMB.1.raw
tcagagcgtcgtctcacgaccggtgctcgatttagtgtgagtagtttggggtttgggggcatgagcaaaactgacaagtcaaggcaggaagatgttgccatcacaactcattggtttctgctgctctgggttccagcctcgagggtgaattgtgctgactcagtctccagtactttcagtctgtgactacgaaaggagaaagtccaaccatccaccgtggcccgggccagtcagtagtcgttggtagtacgcttacgacgtggtaccagcaagaacgccaggtcagtctaccgaaagcctcctcactcaaaggttactcgtccttacccagttcccttcttccggtaccgggttcccccttaggtacggtttcacggttcggacctaggtcggagtcgtagggacctacgtacgtttacccaccctccaacctatacaactacgccgtaggaactacgtagtaacgagtcgtactcgtaacttaaactttaatttaccgtacgtacctaacgtacgtaagttaacggtttaaccctttaaccgtttaaccctacgtaagttcgtaaccttcccgtaaccgtttaccggaccgtaaacgggtacctaaaccggtacggtaacggtaaaccgttaaacgtttaaaaccggtaccgttacgggttacgtacccggtaacgtacccgtaaccctcgttaccgttcccgtttaccccg

SEQ ID NO: 171079 - DNA, 647 bp, Homo sapiens
  misc_feature: GYAE6OF01BV1FR.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaaggagaaacgtccaccatccaccgtcggccgggccagtcagagtcggttggtagtagtcttaacacgtggtaccgagcaagaacgccgaggtcacgtcctaccaaagcctcctacatacaagtactcgtccttcctacgttccttcgtaccgtaccgggtcccctacggtacggtttcgaggtcggacgaggtcggtacgttcgtacggggacctaactaccgtttaccgacccctacacccactaccaagtacgtccgtaggacgtacgtaggaagtctacgtcgtacgtacttaactttacttacgttgtactactcgaagtacgttaaccttacctttacacgttaagtctacgttaccgtaccgttaccggaccgaacgggtaccacgtacgtacggtagtaacgttaaaccgg

SEQ ID NO: 171080 - DNA, 625 bp, Homo sapiens
  misc_feature: GYAE6OF01ABVFQ.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtnaaattgtgctgactcagtctccagacttttcagtctgtgactccaaaggagaaagtcaccatcacctggccggcagtcagagtcgttggtagtagcttacgactgtaccagcagagccaggtcagtctacaagctcctcatcaagtactcgtccttcccacgtcctctccgacgggtcccctggtacgttcgacggtcggcgtagtggtactcgtcgggaactacgtactttccacccgtcaccgtatccaaagtcggtaccgtaggaacgcgttacggaacgtagtcgtacgtacgtacttaacgttacgtttaaccgtagtacctaagtaccgtaagtaacgttaccttaccgtttacctacgtaacggtcgtaactaccgtacccgttacggaccgtaacggtaccacggtacgtaggaacgtaacgtaacgtacgttggaccggtacgtacgaccgtacacttcgtcgtccttacg

SEQ ID NO: 171081 - DNA, 611 bp, Homo sapiens
  misc_feature: GYAE6OF01CYK23.27.78.H01.1.454.CMB.1.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaaagtcaccatccacctgccgggccagtcagagtcgttggtagtagtcttacnctggtaccagcagaagccagtcagtctaccaaagctccncaatcaaagtatcgcttcccatccttctcgtacggggtcccctgacggttcaggtggcaggtggatcgnggacactattcacccctcaccatcaatgcctaggancgtagaagatgntacgtactaactttactacgtgtcaagttctaagtagttaaccttaacgttttaaccctataaagttcgacttacctacccgtttaccgggaccgtaaacgggacctaacggtaccgtagggaaacgttaaacggttaaaaccgaagttcggttacggaccttacggtaccctaaccctatttacccgtgtttaccgttacccg

SEQ ID NO: 171082 - DNA, 704 bp, Homo sapiens
  misc_feature: GYAE6OF01D3SBG.27.78.H01.1.454.CMB.1.raw
  modified_base (311)..(311): a, c, t, g, unknown or other
  misc_feature (311)..(311): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactacgaaaggagaaagtcacatccacgtgccggcagtcagagtcgttaggtagtagcttacacgtcggtaccagacgaagaacgcgaaggtcacgtctaccgaaagcctcctacatacaaagtntcgccttcccacgttccttcgtaccgacgggttcccctgaggttcaggtggacgtaggtcggtatcgaggacctacgtacttccaccctacacctataacaacgtacgaccgtaggtaacgactaggaaagtattgtaccgtagtacccttaaactttacgttacctagtctaaacgtacaaggttacttaacctttaacgtttacctaacggtaagtacgtaacttcccgtaaacccggttacccgggaaccggttaaacgggaaccgtaaacgggtacgtaaacggggtaaacgtaaaaccgtttaaaaacgggtaacgtttggaccggttaccttaaccgggtaaccgtaaacccttacggttcctttaccggttaccctttaaccccgg

SEQ ID NO: 171083 - DNA, 769 bp, Homo sapiens
  misc_feature: GYAE6OF01CQBA7.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccgaggggtgaaattgtgctgactcagtctccagtactttcagtctgtgactacgaaaggagaacgtcaccatcacctgccggcagtcagagtcgttggtagtagtcttacacgtggtaccagacagaacgccaggtcaagtcctaccaaagcctcctacatcaagtctcgtccttccctagttccctttcgtacggtaccggggttcccctcggtaggttccaggtcggctagggtggacgttcgtagggacctacgtactttcccgacccttacaacctactacaactacggcctaggaacgtcgtaaggaagtacttacggtctaacgtaccttaaacgtttaactttaccgtacgttactaacgttacgtaacggtaaccgttttaacgtttaaccctttttaacccgtacgttaaaggttcggttaaacccttacccgttaacccggtttacccgggaaaccggtaaaaccggggtaacccgtaaccgggttaaccgggttaaggggtaaaccggttaaaaccggttttaaaacccgggtaacggtttacggggttacccgggttaacgttaccgggtaaccccttaaccgttaaccgtttcccgttaccggtttttaacccccgg

SEQ ID NO: 171084 - DNA, 628 bp, Homo sapiens
  misc_feature: GYAE6OF01DME5Z.27.78.H01.1.454.CMB.1.raw
  modified_base (90)..(90): a, c, t, g, unknown or other
  misc_feature (90)..(90): n is a, c, g, or t
  modified_base (118)..(118): a, c, t, g, unknown or other
  misc_feature (118)..(118): n is a, c, g, or t
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
  modified_base (199)..(199): a, c, t, g, unknown or other
  misc_feature (199)..(199): n is a, c, g, or t
  modified_base (265)..(265): a, c, t, g, unknown or other
  misc_feature (265)..(265): n is a, c, g, or t
  modified_base (320)..(320): a, c, t, g, unknown or other
  misc_feature (320)..(320): n is a, c, g, or t
  modified_base (454)..(454): a, c, t, g, unknown or other
  misc_feature (454)..(454): n is a, c, g, or t
  modified_base (592)..(592): a, c, t, g, unknown or other
  misc_feature (592)..(592): n is a, c, g, or t
tcagagcgtcgtctcacgaccggtgctcgatttagtgtgagtagtttggggttgggggcatgagcaaaactgacaagtcaaggcaggaanatgtgccatcacaactcagttggtttcngctgctctgggttccagcctccaggggtnaaattgngctgactcagtcctcctagacctttcagtctgtgactccaaaggnaaagtcacatcacctgccggcagtcagagcgttaggagtagcttacacgtggtaccagacagaacnccaggtcaagtcctacaaagtctacctacactcaaggtactcggacctttacccngttccttcgcgtacggggtcccctcggaacggtttccgaagtcggtacaggttggaacgttcgtagggaactctactttccgacccttacaaccgtaattacaagttacgccgttaaggaacgctaggaaagtntcggactagaacctaagttaacttacgtagtactaatccgaagtaccttaacgtaacctttaccactaacggtctactaccgtaccgttacggaccgaaacggtacaacccggtagtacggaataaaccgttaaacgngtcggtagacttcgactacgtaacttcgtgttaccc

SEQ ID NO: 171085 - DNA, 621 bp, Homo sapiens
  misc_feature: GYAE6OF01C2CLI.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggtccagcctcgaggggtnaattgtgctgactcagtctccagactttcagtctgtgactaccaaaggagaaagtcaccatccacctgccgggccagtcaggagtcgttggtagtagcttacacgtggaaccagcaagaagccaggtcagtctaccaaagctcctcatcaagtatcgcttcccagtccttctcgacggggtcccctggtaggttcaggtggctagtggatcgtgggacactactttccacccctcaccatacaatacgcctaggaacgtctagaagagtcgtctgtaactaacgtttattactgtacatacaagtacgttaacttacctttacctactaaggttacgtacttacctacccgtttaccggacccgaaacgggtaccgaaacggtacgttagggaaacgttaaacgttaaaccggaacggttcgggtacggtaccttacggtaccctaaccgttatttccgtcggttacgtttaaccc

SEQ ID NO: 171086 - DNA, 537 bp, Homo sapiens
  misc_feature: GYAE6OF01AHPRB.27.78.H01.1.454.CMB.1.raw
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgacgggtcccctcgagttcagtcggcagtggatcgtggactacactttccaccctcgacctataccaatacgccttaggaagctagaagagtgctagactaaacttattactntcatcagtatacttacttacctactagtntatcctaccgttcggaccgaagggccacgtacgtaggaagtacttaaacgacgtggtcgctcgacctacatctgtcttaccg

SEQ ID NO: 171087 - DNA, 643 bp, Homo sapiens
  misc_feature: GYAE6OF01AQR0P.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactcaaaggagaaagtcaccatccacctggccgggccagtcagagcgttggtagtagcttacacgtggtaccagcagaacgccaggtcagtcctaccaaagcctcctacatcaagtatcggtccttcccgtagttcccttactccggtaccgggggttccccctacggtacggtttcaagggttcggcctaagggtcggaattccggtacgggaactacgtactttcccaccccttacaccctatacaagtacgtaccgtaggaactacgtagaagtactgccgtagacttaacttacttactgttacactacaagtacgttaccttaccgttacctacgtaacgtcgtacttaccgtacgttccggaaccgtaaacggggtacctaacggtacggtaaggaacgttaaacgtaaacggtaaccgg

SEQ ID NO: 171088 - DNA, 772 bp, Homo sapiens
  misc_feature: GYAE6OF01DBE9R.27.78.H01.1.454.CMB.1.raw
  modified_base (148)..(148): a, c, t, g, unknown or other
  misc_feature (148)..(148): n is a, c, g, or t
  modified_base (720)..(720): a, c, t, g, unknown or other
  misc_feature (720)..(720): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcaggggtnaaattgtgctgactcagtctccagtactttcagtctgtacgactaccgaaaaggagaaacgtcaccatccaccgtcggccgggccagtcagaggtcggttaggtagtagtacttacacgttcggtaccagacaaggaacgccgaggtcacgtcctaccaagtcctcctacatacgaagttactcgtacccttacccgacgtttcccgttaccgtaccgggtacccggggttcccccttaggtacgggtttaccggaagggtcgggtaccgtaaggggttacgggtacgttaccgggtacgggtaaccctaccgttaacgtttaccccgaaccccttaccgtaaaccctaagttaacctaaacggttcccggtaaccggtaacggggtaaacgtaccggtaaggaaaacgttcgtacggtaactcgtaacttaactttacttacgtcgtaacacttacggtaattacgttaaccttttaaccgtactacgtaaggtctaacctaccgtacccgttacggaaccgtaacgggtaccaacgggtagtaacgggtaaagtaaacgggttaaaaccnggtttacggaccgtacgttacccgacctaactacgttccggtttcttacccg

SEQ ID NO: 171089 - DNA, 612 bp, Homo sapiens
  misc_feature: GYAE6OF01DTMW2.27.78.H01.1.454.CMB.1.raw
  modified_base (593)..(593): a, c, t, g, unknown or other
  misc_feature (593)..(593): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagactttcagtctgtgactaccaaaggagaaagtcaccatccacctgccgggcctagtcagagtcgttggtagtagtcttacactcggtacagcagaacgcaggtcagtctaccaaacgctcctcatacaagttactcggtaccttcccgacgttccttcgtccgtacggggttccccctaggtacggttcaggttcggctaggtcggaacttcgacgggtaacactacgtttccaaccctcaaccgatacaatacgccgttaggaacgccttagaacgtatcgctacgtactaactttattactcgtacacttacgagttaacgttacttactttaccagtaacgtgacttccgtaccgttacgacgaacggacctacggtactaggaactaacgtaaacgcgtaggtcgtcacggtcctaacngttacttcgttcttacccg

SEQ ID NO: 171090 - DNA, 721 bp, Homo sapiens
  misc_feature: GYAE6OF01CX27C.27.78.H01.1.454.CMB.1.raw
  modified_base (145)..(145): a, c, t, g, unknown or other
  misc_feature (145)..(145): n is a, c, g, or t
  modified_base (699)..(699): a, c, t, g, unknown or other
  misc_feature (699)..(699): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgagggtnaaattgtgctgactcagtctccagtactttcagtctgtgactacaaaggagaagtcaccatcacctgccggcagtcagagcgttggtagtagtctacacgtggtaccagcagaacgccaggtcagtcctaccaaagcctacctcaatacctaagtactcgccttaccctacgtcccttcgtccgtaaccggggttcccccgtaggtacggttaccgtaacggtcgggtaccgtaggttcggaacgtttcggtacgggaaccctaacttaacctttacccgtaacccccttactaaccctaactaacctaaaacttaccggtacccgttagggaacgtaccgttaaggaaacgtacgtcggtacgtaacgtaacccttaaactttacgtttacgtaacggtctaataccgtaagtaaccgttacttaaccgtttacaacgtaacgtactaactccgttaacgtacccggtaccgaaagggtaaccaccggtagtaacgggtaaagtaaacgttaaacccggagtaccgttggaccctacggaaccctaaccgttnttacccgtcgttcttaaccccg

SEQ ID NO: 171091 - DNA, 593 bp, Homo sapiens
  misc_feature: GYAE6OF01AZESA.27.78.H01.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggggcagtgagcaaaactgacaagtcaaggcaggaagatgttgccatcacaactcattgggtttctgctgctctgggttccagcctcgaggggtgaattgtgctgactcagtctccagtactttcagtctgtgacctaccgaaaaggagaaagtcaccatcacctggccggccagtcagagtcgttggagtagcttacacgtggtaccagcagaagccaggtcagtcacaaacgtctcctnatcaagtntgccttccatccttcncgtacggtcccngacgttnagtggacaggtgactcgtaggacactagttcccaccctacaactatacgaacttacgccgtaggaacncgttagaaacgtctgactcgtaacctaattcgttaactgtactagtctagtaacttaccgttaacttaccgtaataagttagtacttccgtaccgttacgaccgtaaggacctaccgtaagcggtaacgtaattaaacggtacgttagtcggtactacgaaccctacgtacttccgttggttaccc

SEQ ID NO: 171092 - DNA, 717 bp, Homo sapiens
  misc_feature: GYAE6OF01BSDZW.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaattgtgctgactcagtctccagtactttcagtctgtgactaccaaaggagaagtcaccatcacctgccggcagtcagagcgttggtagtagcttacacgtggtaccagacaagaagccgaggtcagtcctaccaaagtcctcctcatacaagttacgtcgtccttaccctacgttcccttccgtaccgtaccggggttcccctacggtacggttcgtacggttcgggctaggtcgggtacgttccggtacgggacctaacgttacctttacccaccccttaccaacctaactactaacgtaccgtaccgtgggaacctaccgtaggaaagtctacgacttacgtaacctttaactttattaccgtcgtactaattacgaacgttactttaaccctttaactttaccttaacgaagttccgtaaccgttcccgttaacccggttaccggaaccggtaaacgggtacctaaccgggtaacggttaacggtaaacggttaaacttaaacggtaacggttcggtcggtaacctaccggtaacctaacctttcgtccgtttccggttaccc

SEQ ID NO: 171093 - DNA, 675 bp, Homo sapiens
  misc_feature: GYAE6OF01A8U83.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggttttctgctgctctgggttccagcctccaggggtgaaattgtgctgactcagtctccagactttcagtctgtgactcaaaggnaaagtcaccatcacctgccggccagtcagagtcgttggtagtagcttacacgtggtaccagcagaagccaggtcagtctccaaagctcctcatcaacgtatgcttcccagtcccttctcaggggtccccctcgaggttcagtggcagtggatcgtgggacacctagtttccaccccgttccaaccctaacttccaaacttacggacccttagggaacgccgttaggaaaggtagtcgtcctacggactaaaccgtttatttaccgttagttcctaacttaccgagtaacggttaacctttaaccttttaacccttaccgtaaacgttagtaacttcccgtaacccgtttacccgggacccgtaaaaggggacccgtaaccgaaccggtacggggtaacggtaaactttaaaacccggtaaacgttcgggttacggtccgttacggacctaacccgtacttcttcggttccttttaacccg

SEQ ID NO: 171094 - DNA, 562 bp, Homo sapiens
  misc_feature: GYAE6OF01EOWQO.27.78.H01.1.454.CMB.1.raw
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (555)..(555): a, c, t, g, unknown or other
  misc_feature (555)..(555): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgaggggtgaattgtgctgactcagtctccagtactttcagtctgtgactaccaaaggagaaacgtcaccatcaccgtgccggcagtcagagtcgttggagtagtcttacacgtgtacagcagacgccaggtcagtctaccaagctcctcatacaagtntcnccttcccacgttccttacgtcgacgggtcccctagtacggttcagtcggacgtagtggactcgtacggactactacgttccaccctacacatacaatcgccgtaggactgtagaagntacgctagactaacttnttacgtctanacgtnaacgtataccttacttacgtactagtcgtactactaccgtacgacacggacacgtacgtaggaactaacgtaacgtcgtagtcgactacgacacgttctacgtnttacccg

SEQ ID NO: 171095 - DNA, 680 bp, Homo sapiens
  misc_feature: GYAE6OF01D563J.27.78.H01.1.454.CMB.1.raw
  modified_base (178)..(178): a, c, t, g, unknown or other
  misc_feature (178)..(178): n is a, c, g, or t
  modified_base (229)..(229): a, c, t, g, unknown or other
  misc_feature (229)..(229): n is a, c, g, or t
  modified_base (545)..(545): a, c, t, g, unknown or other
  misc_feature (545)..(545): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaaattgtgctgactcagtcctccagtactttcagtctgtgactcaaagganaaagtcaccatcacctgccggcagtcagagtcgttggtagtagcttacactcggtaccagcaagaagccgaggtcagtctaccaaagtcctcctacatacgaagtactcgtaccttccacgttccttcgtcgtaccggggttacccctggtaacggtttcacgggttcgggacgtacggtaggtacgtacgggttacgggaacctaacttaccttttacccacccccttacaaccctactaacctaaactaccggccgttagggaaacgtctacggaacgtagtacggctacgtaccttaaactttacttaacgtnttactactacgtaacggttacttaacccttttaacttacctaacgttaggttacgtacttaccgtacccgtttaacggacccggtaaacggggtacccaacggtaccgtaggaaacgttaaagttaaaacccggg

SEQ ID NO: 171096 - DNA, 609 bp, Homo sapiens
  misc_feature: GYAE6OF01CQLFC.27.78.H01.1.454.CMB.1.raw
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (481)..(481): a, c, t, g, unknown or other
  misc_feature (481)..(481): n is a, c, g, or t
  modified_base (514)..(514): a, c, t, g, unknown or other
  misc_feature (514)..(514): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaagtcaccatcaccgtcgccggccagtcagagcgttggtagtgcttacactggtaccngcaagacgccagtcngtctaccaaagcctcctacatactaagtactcgtccttcccagttcccttccgtaccggtaccggggttcccctcggtacggtttcgaaggtcggacgaggttcggacttcggtgggaacctactactttccacccctacaccctatcaaatcgaccgtaggaagtccgtagaagtntcgctgtacttaacttattactgtacacgttanagtaacgttacttaccttaccataacgtcgtacttaccgtccgttaccggaaccgaacgggtaccacgacgtacggaacgtaaagttaaacccgg

SEQ ID NO: 171097 - DNA, 617 bp, Homo sapiens
  misc_feature: GYAE6OF01CD292.27.78.H01.1.454.CMB.1.raw
  modified_base (200)..(200): a, c, t, g, unknown or other
  misc_feature (200)..(200): n is a, c, g, or t
  modified_base (408)..(408): a, c, t, g, unknown or other
  misc_feature (408)..(408): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagacttttcagtctgtgactccgaaaagganaaaagtcaccatcactgccgggcagtcagagcgttggtagtagcttaacactggtaccagcaagaagccaggtcagtctaccaaagctcctcatcaaagtatcgccttcccagtccttctcgtacggggtcccctcggagttcagtggcaggtggatcgtggacactatttcaccctcaccatcaaatacgccgtaggaagctagaanatgctagactaactttattactgtctaactcgaagtagttaaccttacttttaacccgtaactaaggttacgtacttaccgtaacccgtttacggacccgaaaaggggacctaaccggtacgtaagggtaagtaaacgtttaaaaacggtaacgttgggtacgggtacctacggtaaccctaacccgtattacttcggttctttaaccc

SEQ ID NO: 171098 - DNA, 815 bp, Homo sapiens
  misc_feature: GYAE6OF01D3CEO.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgagggtgaaattgtgctgactcagtctccagtactttcagttctgtcgacctaccgaaaggagaaagtcaaccactccaccgtcggccggcagtcgaggagtcgttaggtagtacgtcttacacgtacggtaccagacgaaggaacgccgaggtacacgtacctaccgaacgtcctacctactactactaagtacgtacctacccttacccgtacgttcccgtttaccgtaccggtacccggggttccccgttacggtacggtttcgacggtcggtacgtaggttggtacgtcggtacgggaactaaccgttactttacccgacccttaccgaaccctactaaccaacgttacgaccgtaggtaacgtccgttaagtaacgtagtacgtacgttacgtaacctttaactttacgtttaacgtcgtttaacctagttaaccgtaaggttaaccgtttaacccttttaacccgtttaaccgttaccgtaagtttaccgtaacctttacccgttaacccggttacccgggtaaaccggtaaacggggttaacccgtaccggttaaacggttaacgggtaaaaccggtttaaagttaaaaccccggttacggttacgggttacgtacccggttacggaacccgtaaccgttacggtttccgtttcccggtttaacccg

SEQ ID NO: 171099 - DNA, 551 bp, Homo sapiens
  misc_feature: GYAE6OF01EABXV.27.78.H01.1.454.CMB.1.raw
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcacgggtcccctcgagttcagtggcagtggatcgtgggacactatttccaccctcaccatacaaatacgcctaggaagtctagaagatgctagactaacttattactgtcatcgaagtacgttacttacttaacctntaagtntactcctaccgttcggaccgaagggacacgtactaggacgtaaacgttaaacgacgttggtaggctacgacctaacctattcttgttcttacccg

SEQ ID NO: 171100 - DNA, 760 bp, Homo sapiens
  misc_feature: GYAE6OF01BLO7J.27.78.H01.1.454.CMB.1.raw
tcagagcgtcgtctcacgaccggtgctcgatttagtgtgagtagtttggggtttggggatgagcaaaactgacaagtcaaggcaggaagatgttgccatcacaactcattgggtttctgctgctcgtggttccagcctccgaggggtgaaattgtgctgactcagtcctccagtacttttcagtctgtgactacgaaaggagaacgtcacactcacctggccggccagtcgagaggtcggttggtagtacgtacttaaccacgtacgtaccagacgaacgaacgaccgaggtccagtaccgtaccgaacgtcctcctacactaaccgtaagttactacgtccctttaccctaccggtttacccttcccgtaccggtacccggggttacccccgttacgggttaccggttccggtacggtcgggtacggtacggttacggtacgtacggtacgggtaacctaacgttaaccgttttcccaacccccttactaaccctacgtaacctaaacgtacggtcccgtaaggaacggtacttaaggaacgtatacgtcgtacgtaaccttaacgtttacttagttcgtactaacgttacaaggttaacttaacctttaaccgtttacctaacgtaacgttacctacttcccgtaacccgttaccggacggtaacggtacctacggtacggtaacggtaaagttaacgtaaacggtacgttcggtaggtaccgtacgtacctactagttcccttgttcccgttaaccg

SEQ ID NO: 171101 - DNA, 729 bp, Homo sapiens
  misc_feature: GYAE6OF01C2WRV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccgaaaggagaagtcaccatcaccgtcggccggccagtcaggagtcggttaggtagtacgtcttacacgtcggtaccagcaaggaacgccgtaaggtctaggtcctaccgaaagtcctacctcagtacaagttatcgtccttccacgttccttcgtacgaccgggttccctcgtacggttcgaggtggcgtaggtggacttcgtagggactactacgtttccaccctacaccatacaaagtcgaccgtaggaacgtcgttaacggaagtacgtgtacttacggaacctttaaacgtttaacgtttaccgttcggtacctaagttaccgtaaacggttaactttaacccttttaaccgtttaacccgtaacgttaacgtacgttaaccgttacccgtaacccggtttaacccgggaaccgaaacggggtacctaccgggtaaccgttaacgggtaaacgttaaacgttaaaacggtacggtttaggtaccgggtcctaacgtaccctaaccttagttccgttaccgttccctttaaccccg

SEQ ID NO: 171102 - DNA, 601 bp, Homo sapiens
  misc_feature: GYAE6OF01B2O7M.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcggttggtagtagcttacactggtaccagcagaagccaggtcagtctccaaagtctcctcatcaagtatacgcttcccagtccttctcgacgggtcccctcgacggttcagtggcaggtggatcgtgggactacatttccaccctcaccatcaatacgcctggaacgctagaagacgtgactaggcctaactttaacttacttacgttactaatacctaggtacttaaccgttacctttaaccctaactaacgttacgtaacctacctacccgttttaccgggaccgtaaacggggaccaacccggaaccgtacgggtaacgtaaacgttaaaacccggg

SEQ ID NO: 171103 - DNA, 624 bp, Homo sapiens
  misc_feature: GYAE6OF01ANL8A.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactaccaaaggagaaagtcaccatcacctgccgggccagtcagagtcgttggtagtagcttacactggtaccagcagaagccaggtcagtctccaaagctcctcatcaagtatgccttcccagtccttctccgtacgggtccccctcggacggttcagtggcaggtggatcggtgggacactacttccaccctcaccctatacaatcgaccgtaggacgcgtagaagtatcgactgtacctaaacttatttacgtgtcctatacctaaggtacgttaccttaacgttttaacctaacttaagtacgtacttacctacccgttaccgggaccgaaacgggtaccgaaccggtaactacggggtaaacgtaaacgttaaaccggaacggttaggtcggaccgtcggaacctaccctaaacttccttacggttcctttacccg

SEQ ID NO: 171104 - DNA, 761 bp, Homo sapiens
  misc_feature: GYAE6OF01DUFXO.27.78.H01.1.454.CMB.1.raw
  modified_base (182)..(182): a, c, t, g, unknown or other
  misc_feature (182)..(182): n is a, c, g, or t
tcagagcgtcgtctcacgaccggtgctcgatttagtgtgagtagtttgggtttgggatcttaaaagaggttctttctctggatgtggcatgagcaaaactgacaagtcaaggcaggaagatgttgccatcacaactcattgggtttctgctgctctggttccagcctccagggtgaaattgngctgactcagtctccgagtactttcagtctagtcgactaccgaaaggagaaacgtacaccactccaccgtacggccggccagtcaggagtcggttaggtacgtacgtacttacacgtaggtaccagcgagaacgccgaggtcctagtcctaacgaacgtctacctagaactacgaacgtactcgtacccttaccgtacgttcccttacgtaccggtaccgggttaccccttacggttacggttacctagggtccggacgttacggtaggtacgttacgtacgggtaacctaaccgtacttttaacccgaccccttaccgaaccctaactaactaaacgtccgtaccgtacggaacgtcgtaacgtaacgtatgtacctacgtaacttaacgtttaccttacgttacggttactaacgtacgttaacgtaacggtttaaacccctttaaccgttaccgtaacgtaacggttaccgttaacgttcccggttaaaccggttacccgggtaaacgtaaaacccgggtaccgtaaaacccggtaaggtttaaacgggtaaagttaaaaccggttaaaacccggg

SEQ ID NO: 171105 - DNA, 756 bp, Homo sapiens
  misc_feature: GYAE6OF01ELLG2.27.78.H01.1.454.CMB.1.raw
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
tcagagcgtcgtctcacgaccggtgctcgatttagtgtgagtagtttgggtttggggatcttaaaagaggttctttctctgggatgtggcatgagacaaaaactgacaagtcaaggcaggaagatgttgccatcacaactcattgggtttctgctgctcgtgggttccagcctcgaggggtagaattgtgctgactcagtcctccagtactttcagttctgtcgactacgaaagganaaacgtccaccatccaccgtcggccggcagtcgagagtcggttggtagtagtacttacacgtacgtaaccngacgagaacgccgaggtacacgtacctaccaaacgccttacctactaactactaaagttactccgtccttacccgtacgttcccttccgtacccggtacccggggttccccttcggtaacggttcgtaacggtcgggtacgtacggtcggtaacttcgggtacgggtaactacgttaccttacccgacccttacaccctactacaacgtacgaccgtagaacggcgtaagagtacgtcgtactacgtaaccttaactttacgttacttagttaccttaagtaccgttaacgttaacgttaacccttaaaccgtttttaaccgaagtttaaacccggtacttaaccgttaaccccggttaaccggttaacccggggaaaccccgtaaacgggaaccgttaacccggttaaacggtaacgggtaaaacgttaaaccggttaaaacccggg

SEQ ID NO: 171106 - DNA, 586 bp, Homo sapiens
  misc_feature: GYAE6OF01CP1UB.27.78.H01.1.454.CMB.1.raw
  modified_base (341)..(341): a, c, t, g, unknown or other
  misc_feature (341)..(341): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagctccaggggtgaaattgtgctgactcagtctccagactttcagtctgtgactccaaaggagaaagtcaccatcacctgccgggccagtccagagcgttggtagtagcttacactggtaccagcagaagccaggtcagtctccaaagctcctcatcaagtatgcttcccagtccttctcgacgggtcccctcgaggttcgagtggcngtggatcgtggactactacttccaccctcaccactcaatacgcctggaagctagaagatgctgactaacttattactgtactatcagtacgttaccttactttaacctagtaacgttcgacttaccgtacccgtttaccgggaccgtaaacgggtaccaaccggtacgtagggaaacgtaacggttaaacgtaacgtcggtacggacttaccggacctaaccgtattcccgttgttcctttaccg

SEQ ID NO: 171107 - DNA, 670 bp, Homo sapiens
  misc_feature: GYAE6OF01AT9GX.27.78.H01.1.454.CMB.1.raw
tcagagcgtcgtctcacgaccggtgctcgatttagtgtgagtagtttgggtttgggatgagcaaaactgaccaagtcaaggcaggaagatgttgccagtcacaactcattgggtttctgctgctcgtgggttccacgcctccgaggggtgaaattgtgctgactcagtctccagactttcagtctgtgactaccaaaggagaaagtcaccatccacctggccgggccagtcagagtcgttggtagtagcttacacgtggtaccagcaagaagccgaggtcagtcctaccaaagtcctcctacataccgaagttactcgtccttaccctacgttccctttcgtccggtaccggggttccccctaggtacggttaccgagggtggtacgtaggtggtaacgttcggtacgggtaactacttactttacccaccccttacaaccctataccaagtacgcccgtaggaacgtcgtaaggaagtactggtactagacttaaacgtttattaactcgtactactacgtaacgtacgttacctttaactttacctacgtagtacgtacttaccgtaaccgttaccgacggaaggaccgtacggtacgaggtaacgtaaacgttaaacgtacggtcggtcgaccgttacgacccacgttacttccttgttccttaccg

SEQ ID NO: 171108 - DNA, 726 bp, Homo sapiens
  misc_feature: GYAE6OF01DIJN8.27.78.H01.1.454.CMB.1.raw
  modified_base (307)..(307): a, c, t, g, unknown or other
  misc_feature (307)..(307): n is a, c, g, or t
  modified_base (514)..(514): a, c, t, g, unknown or other
  misc_feature (514)..(514): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaacgtcaccatccacctcggccgggcagtcagagcgttggtagtagcttacacgtggtaccagcagaacgccgaggtcagtcctaccaagctcctcatacaagtntcgtccttcccgagttcccttctccgtaccgggttcccctcggtacggttccaggttcggaccgtaggtcgggtaacgtcggtacggggtaacctaacgtaacgttttacccaccccttaccaacctataccaaagttaccggacccgtagggaaacgtccgtaaggaaacgagttcgcgttacgtaacttaactttattaaccgtnttactaacgttactaaggttactttaaaccttaccgttttaaccctacgttaacggttactaaccgttacccgttaaccccgtttaccgggaaacccgtaacgggaaccctaaaccgggtaacgtaacggggtaaaacgttaaacgttaaaaccggtacggttacggttacggaccgttaccgaacctaccgtacttcgttccgtttaaccc

SEQ ID NO: 171109 - DNA, 744 bp, Homo sapiens
  misc_feature: GYAE6OF01AYVWN.27.78.H01.1.454.CMB.1.raw
  modified_base (549)..(549): a, c, t, g, unknown or other
  misc_feature (549)..(549): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgcctcgtggttccagcctccgaggggtgaattgtgctgactcagtcctccagtactttcagttctgtagacttaccaaaggagaaacgtctacccatccgaccgtcggccgggccaaggtcagacggtcgttgggtacgtagtcttacgacgttggaccagcgagaagccaggtcacgtctccaaagcctacctcattaccgaagttacgtcgtcccttacccgtacgttcccttcgtacccgtacggggttccccgtacggtacggtttacgtacggtcggtcgaacggttcggtaactcgtacgggacctacgtacttttaccaccccgtacctacctacttaacgaacgttacggcccgttagggaacgtcgtaacggtaacgtagttacggacttacggtaaccttaacgtttacttaaccgtttntaaccctagttaacacggtttaactaacctttaacgtttaaccttacgtaacgttagtacccttacccgttaaccgttaccggaaccgtacgggtaacgtaccggtaaacgttacggaaagttaacgttaaaacccgacgttaccggtcgtaaccgtcgtaaccctactacggttaaccttcggttcttaacccg

SEQ ID NO: 171110 - DNA, 784 bp, Homo sapiens
  misc_feature: GYAE6OF01E56D9.27.78.H01.1.454.CMB.1.raw
  modified_base (152)..(152): a, c, t, g, unknown or other
  misc_feature (152)..(152): n is a, c, g, or t
  modified_base (182)..(182): a, c, t, g, unknown or other
  misc_feature (182)..(182): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagtttgggtttcngctgctcgtgggtccagcctcgaggggtanaattgtgctgactcacgtcctcctagtactttcagtctagtcgaacctaccgaaaggacgtaacgtccacctactccaccgtcggccggcctagtacgaggtacgtcggttaggtacgtacgtaccttaacgaccgtacggtaccgagacgaacggacgtcgtacgtcgacgtacctacgaactccgtacctacactactaagtcgttaccgtccttaccgtaccgtttcccgttacgtacccgggttacccgggttcccgttacggtacggttacggtacggtcggtacggttaaggttacggtaccgttacggtacgggtaaccttaccgttaaccgtttaccccgaacccttaaccgaacccgttaagtaccgaacgttaccggtacggtaggtacgtacgtaacggtaactacgtacgttacgtaacgttaaccttaacggtttctaccgttacttacgtaaccgttacgtaccgttaaccgttaccgtttaaccttaccggaacttacggtaccgtacccgttacccggttaccggtacccggaaccggtaacggtacgaaccggttacgaacggttaacgtaaacgtttaaccggg

SEQ ID NO: 171111 - DNA, 604 bp, Homo sapiens
  misc_feature: GYAE6OF01A5B6B.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgagttcagtgcagtggatcgtgggacacgatttccaccctcaccatcaatacgcctaggaagctagaagatgctagtacctaactttattactgtacacttcacgtaagttaccttaaccttttaaccctacgtaagttgtaacttaccgtacccgtttccggaacccgaaacggggtaccaaccgggtaaccgtacggggtaacgtaaacttaaaacccggaacgttacggtacgggtccttacgggacctaaccctaagttccgttggtttaccc

SEQ ID NO: 171112 - DNA, 751 bp, Homo sapiens
  misc_feature: GYAE6OF01ELAY5.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctgccggccagtcagacgtcggttggtagtagtccttacactaggtacccagcagaagccgaggtcacgtcctaccaaagcctcctcatacaagtatcgccttccagttcccttctccgtacggggttccccctggtacggttcaggtcgggctaggtggtactcgtacggggacctaacgtactttaccgacccctaccgaaccctacttaacaacgtacgtacccgtagggaacgtaccgttaaggaacgtacgttcggtaccttacggtaacccttaaaccgtttttacgtttaacccgttgtttaacctaagttacccgtaacggttaaaccggttttaaccctttaaacccgtttttaaaccccgttaaccgttaaacggttacgttaaccgttaccccgttaaaccccggttacccgggtaaccccgggtaaaacggggtaacccgtaaaccgggtaaccggttaacgggaaacggttaaaaccggttaaaaacccgggg

SEQ ID NO: 171113 - DNA, 586 bp, Homo sapiens
  misc_feature: GYAE6OF01CO7AU.27.78.H01.1.454.CMB.1.raw
  modified_base (213)..(213): a, c, t, g, unknown or other
  misc_feature (213)..(213): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (579)..(579): a, c, t, g, unknown or other
  misc_feature (579)..(579): n is a, c, g, or t
tcagagcgtcgtctcacgaccggtgctcgatttagtgtgagtagtttgggtttggggatgagacaaaactagacaagtcaaggcaggaagatgttgccatcacaactcattgggttctgctgctctggtccagctccgagggtgaattgtgctgactcagtctccagtactttcagtctgtgactaccgaaaggagaaatcaccatccaccgngccggcagtcagagtgtggtagtagcttacactggtaaccagacgaagaagaccgtaaggtcacgtctaccgaaagccttccacaattacaagtactgtccttaccacgtccttcncgacgggtcccctgtagttcagtcggcaggtgactgnggacactnttcaccctnaaccaatcaaatacgccgtaggaagtcgagaagacgtgacgtacgtactaaactttattactagtcactacaaggtaacttaccttaactttaccctaagtaacgtagtactactaccgttacggacgaaacggactacgacgtagaacgtaaacttaaagacgtggtagcgttacgacccaacgcttactcgttnttacccg

SEQ ID NO: 171114 - DNA, 828 bp, Homo sapiens
  misc_feature: GYAE6OF01BURZZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccgaaaggagaaagtcaccatcacctgccggcagtcagagcgttggtagtagtcttacgactggtaccagcgaagaacgccgaggtcagtacctaccaaagcctcctacactacgaagtactcgtaccttccctacggttcctttccgtccgtaccggggttcccctacggtacggtttccaagggttcggacggtaggtcggtacgttccggtacggggaaccctaacgttacgttttaccccgtaaccccccttaccgtaaacccctaacttaacccgtaaacgttaaccgtcccggttaacgggaaacggtaccgtttaagggaaacgttagttcggtaccgttaacggtaaccctttaaaccttttaacgtttacgttacggttaacccttaacgtaaccgtaacgggtttaaacctttaaccgttttaaaccctttttaaacccgtaaccgttaacggtttacgtaaacctttacccggttaccccgtttaaccggggacccgtaaacggggtaaaccgtaacccggtaacggttaagggtaaaccgttaaacggtttaaaaccggtaacggtttcgggtaccggtaccgtacggtaaccctacgtaccgtttaccgttcgtttccctttacccg

SEQ ID NO: 171115 - DNA, 792 bp, Homo sapiens
  misc_feature: GYAE6OF01BAEYP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccggccagtcagagcgttggtagtagcttacacgtggtaccagcgagaacgccaggtcagtacctaccaaagcctacctcatacaagtactcgtccttccctagttcccttctaccggaccggggttcccccttacggtacggtttaccgaaggttcgggcgtaaggtcgggacttacggtacggggtacctaaccttaacgttttacccgaacccctttacccaaaccctaagttaacccaaacgttaaccggtacccgttaagggaaacgtaccgtaaggaaacggtacgttacgtaaccgttaccggttaaaccttaaaccctttttaaacgtttaaccgtttaccggttacttaaccgttacgtaaacggttaacgtttaaccctttaaaccttttacccgttaacgtaacgttaccgtaacttacccgttacccggtttaacccgggacccgtaaacggggtaaccctaaccgggtaacgtacgggtaaacgtaaaccggtttaaaacgtaaccggttaggtaccggtaccgtacggtaacctacccgtaactttccggttcttccgttaccc

SEQ ID NO: 171116 - DNA, 688 bp, Homo sapiens
  misc_feature: GYAE6OF01BS37Z.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagtactttcagtctgtgactccaaaggagaaagtccaaccatcacctcgccgggccagtcagagcgttggtagtagcttacactggtaccagcaagaacgccgaggtccagtacctaccaaacgcctcctacataccgaagtactcgtcccttcctacgttccttcgtaccggtaccgggttccccgtcggtacggtttcgaggtcggacgtaggtcggacgttcggtacgggacctactacctttaccaccccgttacacccgtattaactaacgtacgtacccgtagggaacgcgttacggaaagtgttacgcgttacgaccgtttaactttaactttaccgtagttaccaagttacgtacggtaaccgtttaaccttaaccctttaccgtaacgttaacgttacgtaaccttaccgtaccccggttaccggaaccgaaacgggtaccaccggtaacgtaggtaaaacgtacgttaaaaccgg

SEQ ID NO: 171117 - DNA, 742 bp, Homo sapiens
  misc_feature: GYAE6OF01AQ4H0.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccggccagtcagagcgttaggtagtagcttacacgtggtaccagcagaagccaggtcagtctaccaaagcctcctcatacaagtatcgccttcccagtccctttccgtccgtaccggggtccccctcggtacgggtttccaggttcgggacctaggttcgggtaacttccggtacggggaacctaccgtaacttttacccgacccccttaccaacccctattacccgaaacttacggacccgttagggaacgtcgttaggaaagtagttacggaccttacggtaccttaaactttaacgtttaaccgttagttacctaacgttaccgtaaggttaaccgtttaacctttaaacccttttaacccttacgtaaacgttacgtaaccttaccgtaacccgtttacgggaacccgtaaacgggtaccgaaccggtaacgtacgggtaaacgttaaaccttaaaacgggtaacgttcgggtacggttaccgtacggaccgtaaccctaacgttccgttacgtttaccccg

SEQ ID NO: 171118 - DNA, 578 bp, Homo sapiens
  misc_feature: GYAE6OF01C566G.27.78.H01.1.454.CMB.1.raw
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaagtcaccatcacctgccgggccagtcagagcgttggtagtagcttacnctggtaccagcagaagccaggtcacgtctaccaaagctcctcatcaagtatgccttcccagttccttctcgacggggtcccctcgaggttcaggtggcagtggatcgtggactacnctttcaccctcaccatcaatcgaccgtgaacgctgaagatgctagacctaactttatactgtactatactaagtacgttaacttactttaccctacgtaagtcacttccgtacccgttcggaaccgtaacgggaccacggtacgttaggaactaaagttaaacggaacttcgggtaggtccgttacggacctacctacttccgttagttacccc

SEQ ID NO: 171119 - DNA, 627 bp, Homo sapiens
  misc_feature: GYAE6OF01BYFY7.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccaggggtgaaattgtgctgactcagtctccagactttcgagttcgtgtgactaccgaaaggagaaacgtcaccatcacctggccggcagtcgagagcgttaggtagtagcttacgacgtggtaccagcaagaagccaggtcagtctaccaagctcctcatacaagtatcgccttcctagtccttcgtccgacggggttcccctggtaggttcaggtcggcgtaggtggtactcggtacggactactacgtttccaccctcacacttcaaattcgacgtaggagcgtagagtatgacgtcgaactaacttagttaccgtagtactatacgtaagtacgttaaccttacttaacctataacggtctaccgttaccgtaccgttacgggaccgtaacggaccgtacgtacgtaacggtaacgtaaacgttaaacggtacgttcggtacgtaccgtacgtaccaaccgttaattcgttacgttcccgttacc

SEQ ID NO: 171120 - DNA, 586 bp, Homo sapiens
  misc_feature: GYAE6OF01CIO47.27.78.H01.1.454.CMB.1.raw
  modified_base (361)..(361): a, c, t, g, unknown or other
  misc_feature (361)..(361): n is a, c, g, or t
tcagagcgtcgtctcacgaccggtgctcgatttagtgtgagtagtttgggtttggggagtgagcaaaactgacaagtcaaggcaggaagatgttgccatcacaactcatttggtttctgctgctctgggttccagcctccgaggggtgaaattgtgctgactcagtctccagactttcagtctgtgactccaaaggagaaagtcaccatcacctgccgggcagtcagagtcgttggtagtagcttacacttggaccagcagaacgccaggtcagtctccaaagctcctcatcaagtatcgcttcccagtcctttcgtcgtacgggtcccctcggtacggttcaggtggctaggtggatcgnggactactactttccaccctcacctatacaactacgcctaggaacgctaggaagtatgctagacttaactttattacgtgtacatactagtacgttaaccttaactttacctagtaacgttacgtacttccgtacccgttacggaccgaacgggacctacgacgtaggaacgtaacttaaaccggagtcggtacggctcgacctactatccgttcgtcttacccg

SEQ ID NO: 171121 - DNA, 543 bp, Homo sapiens
  misc_feature: GYAE6OF01A3OV8.27.78.H01.1.454.CMB.1.raw
  modified_base (536)..(536): a, c, t, g, unknown or other
  misc_feature (536)..(536): n is a, c, g, or t
tcagagcgtcgtctcacgaccggtgctcgatttagtgtgagtagtttggggtttgggggggcatgagcaaaactgacaagtcaaggcaggagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaagtatgtcttcccagtccttctccgacggggtcccctcgaggtttcaggttggcaggtggatcgtggggacacgtatttccaccctcaacccatcaatacgccctaggaacgctagaagtatagctgacctaacttatttactgtacatcaagtagttaccttacgtttaacctctaagtgactctaaccgttcggaccaagggacacgacgtaggactaataacgatagtgactcgcacntcgtgtc

SEQ ID NO: 171122 - DNA, 651 bp, Homo sapiens
  misc_feature: GYAE6OF01EZ416.27.78.H01.1.454.CMB.1.raw
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggtagtagcttacactggtaccagcagaagccaggtcagtctcaaagctcctcatcaagtatcgcttcccagttccttctcgacggggttcccctcgaggttcagtggcagtggatcgngggacactattcaccctcaccatcaatacgcctaggaanctaggaantgactgactaactttattactgtacatactaagtacgttaacttaccttttaaccgacgtaaacggttgtaacttacccgtaacccgtttacccggggaaccccgtaaaaggggtacccaaaccgggttaaccggttacggggtaaacgttaaaaccgttttaaaaaacccgggaaacgtttccgggtacggtaaccgttacgggaacccctaaaccccgttaagtttccccgttacggtttaacccc

SEQ ID NO: 171123 - DNA, 592 bp, Homo sapiens
  misc_feature: GYAE6OF01A9HDG.27.78.H01.1.454.CMB.1.raw
  modified_base (359)..(359): a, c, t, g, unknown or other
  misc_feature (359)..(359): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgtcttccgtagtcctttctccgtacggggtcccctcggtacggttcaggtcggcagtggatcgngggacactactttccaccctctacctagtccaaagtacgaccgtaggaacgtcgttagaaacgtacgtcgacgtcgtactaaacctttattaacgtgtacctaagtacagtagttacctactttacctacgtaagtagtactaccgtaccttacggaccgtaaggaccacgaccgtaggacgtaaacgttaaacgacgtacgtcggactcgacctacgatacgttcgtcttac

SEQ ID NO: 171124 - DNA, 536 bp, Homo sapiens
  misc_feature: GYAE6OF01DUSX5.27.78.H01.1.454.CMB.1.raw
  modified_base (248)..(248): a, c, t, g, unknown or other
  misc_feature (248)..(248): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
  modified_base (531)..(531): a, c, t, g, unknown or other
  misc_feature (531)..(531): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgcccgggccagtcagagcgttggtagtagcttacnctggtaccagcagaagccaggtcagtctcaaagctcctcatacaagtatcgcttcccagtccttctccgacggggtcccctcggtacgttcgagtcggcaggtggatccgtgggtacacgtactttccaccctcacctactacaatacgaccgtaggaanactgaaagtatgactgactaacttnttactgtcatcagtatactaactttcctanatgactcacgtccggacaaggccacgactaggaactaattaacgactggtagctgacacctatccgtnttacc

SEQ ID NO: 171125 - DNA, 639 bp, Homo sapiens
  misc_feature: GYAE6OF01AE9WT.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacacgtcggtaccagcagagccagtcagtctaccaaagctcctcactcaagtatcgtcttcccagttcccttctcgacgggtcccctcgaggttcaggtggcaggtggatcgtggggacctacgtacttttaccacccctacaaccctagtaccaaactacggtaccgtacgggtaaacgcgttacggaaagtagtacgacgtacgtacctaaaccttttattaaccttaggtactatccgtaagtaacgttacttaaccttttaaccctacgtaagtacgtacttaccgtacccgtttacggaccgtaaacgggtaccaacgtaacgtacggaacgttaagttaaaccggacgttacggtacggctacggacccaacgttactcgttgttaccc

SEQ ID NO: 171126 - DNA, 805 bp, Homo sapiens
  misc_feature: GYAE6OF01CL8BK.27.78.H01.1.454.CMB.1.raw
tcagagcgtcgtctcacgaccggtgctcgatttagtgtgagtagtttgggttggggatgagacaaaactgacaagtcaaggcaggaagatgttgccatcacaactcattgggtttctgctgctctgggtccagcctcgagggtgaattgtgctgactcagtctaccagtactttcagtctgtagacctaccgaaaagggaagtaaaacgtcaacctataccgaccgtcggacccgggaccagtacgaggacggtcggttaggtacgtacgacttaccgacgttacggaccagaccgaaggaacgccgtaaggtcgtaacgtacctaaccgaaagtccctacctactaacgtacgtaaacgttctaccgtcccttacccgtacgttcccttccgtaccggtaccgggttcccctacggtacggttacgtacggtcggacgtaggtacggacgttacggtaggtaacctaacgttacctttacccaccccttaccaaccgtaactaccaaacgtacggtaccgtaagggtaactacggttaacggaagtacttacccggtagttaacggtaactttaaacctttacgttaaccgtaaggtacctaaccgttaacggaaactttaacgtttaacccttaaacgtttaaccgtaacgttaacgttaaccgtacccgttaacccgttaccggttaaccgggaaccggaaccggtaactaccggtaggtaaacggtaacgtaaaaccgttaaaccgtaggttcgaccggtaactaccggtacctaactggttacttccggttacttacccg

SEQ ID NO: 171127 - DNA, 749 bp, Homo sapiens
  misc_feature: GYAE6OF01EK7VJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagctcctcatcaagtatgtccttcccagtcccttctcgacggggtcccctgacggttcagtggcaggtgatcgtggacactattccaccctcaccataccaatacgaccttaggaacgtcgttaaggaaagtacgttcggacgtacgtaaccttaaaccttttactttaaccgttacggttacctaacgttacgtaaacggttaaccggtttaaccctttaaaccgtttttaacccgtaaccgttaaaggttaccggttaacctttaacccgttaaccccggtttacccgggtaacccccggtaaaacgggggtaaaccccgtaaacccgggtaaccggttaaccggggtaaaacggttaaaaccgttttaaaaacccgggtaaacggttaccggggttaaccgggtaccgttaccggtaaccccgttaacccttaacgtttcccgtttaccgggttccctttaacccccg

SEQ ID NO: 171128 - DNA, 750 bp, Homo sapiens
  misc_feature: GYAE6OF01CVXPT.27.78.H01.1.454.CMB.1.raw
  modified_base (287)..(287): a, c, t, g, unknown or other
  misc_feature (287)..(287): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctcgagggtgaattgtgctgactcagtctccagtacttcagtctgtgactcgaaaggacgaaagtcaccatcaccgtgccggcagtcagagcgttggtagtagcttacactggtaccngcagaagccaggtcagtcctaccaaacgcctcctctataccgtaagtaactcggtcccttacccgtacggttccctttccgtaccgtaaccgggggttcccccctaggtacgggttctaacggtgggcgtaacggttaggacgttccgtacggggtaacctaacttacgtttacccaacccccgttaccaaccctaactaacctaaacgtaccggtacccgttagggaaacgccgttaggaaacgtagtcggtacgtacggtaaccttaaatttacgtttaacttcgttaaccttaagttaccgtaacggtaaacgttttaccttaacccgttttaccgtaaccgttaaaggtcgtaaccgtttacccgaaacccggttttaccgggaaaccccgttaaaccggggaaacccgtaacccggttaacggttaacgggaaaacgttaaacgtttaaaaacccggg

SEQ ID NO: 171129 - DNA, 617 bp, Homo sapiens
  misc_feature: GYAE6OF01A8PT7.27.78.H01.1.454.CMB.1.raw
  modified_base (298)..(298): a, c, t, g, unknown or other
  misc_feature (298)..(298): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaacgccaggtcagtctaccaagctcctcatcaagtntcgtcttccacgttccttcgcgtacggggtcccctcggtaggttcgagtcggctaggtggatcgtgggactactatttccaccctcaccatacaatacgccgtaggaaccgcgtaggaaacgtatcggtacttagtaacctaactttattacgtgtacctatacgaagtacgttaaccttacctttaacctacgtaacgttctaacgttcctaaccgttccggaaccgtaagggaccaacggtaacgttacgggaaacgtaacgttaaaccggacgttaggtacgtacgttccgacctaaccgtcttccgttcgttacc

SEQ ID NO: 171130 - DNA, 706 bp, Homo sapiens
  misc_feature: GYAE6OF01EIYN3.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtacttttcagtctgtcgactaccgaaaggagaaacgtaccaaccatccaccgtcggcccggaccagtcagagtcggttggtagtacgtccttacgacgtggtaccagcgaagaacgccgaggtcacgtcctaccaaacgtcctacctacactactaagttctacgtccttacccgtacgttcccttcgtacccggtaccggggttccccctacggtacggttaccgagggtcggacgtaggtacgggtactcggtacggactacgtacgtttcccaccctaccacctatacaacgtacgaccgtaggaacgtcgtaagaacgtcgtacgtactacgtaaccttaactttacttacgttacgtactagtacgtaaggttaccttacctttaacctttaccgtagtaacgttcgtacctaccgttaccggttacccggaacggtaacgacgtaaccggtaacgtaggtaacgtaacgttaaacgacggttcggtacggtactacgtaccacgttactttccgtacgttcttaacccg

SEQ ID NO: 171131 - DNA, 676 bp, Homo sapiens
  misc_feature: GYAE6OF01BB5OU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtcgactaccaaaggagaaacgtcaccatccacctggccggcagtcagagtcgttggtagtagtcttacacgtacggtaccagacaagaacgccaggtcacgtcctaccaaagcctcctcatacaagtactcgccttcccagttccctcgtcgtacgggtcccctggtaggttccaggttcggctaggtcggtatcggtacggactacgtactttcccgacccttacaacctataccaaagtacgccgtaggaacgcgtagaagacgtgcttagaacttaacgtttaacttacgtgtactactacgtagtaacgttaacctttacgtttacctacgtaacgttacgtaaccttcccgtaaccgtttaccgggaaccggaaacggtaccgtaaccgtaacggtaacgggtaaacgtaaaccgtttaaacggaacggttaggtaccgggtactacgtaacctaacgtactttccgttcgtttacccgtttacccg

SEQ ID NO: 171132 - DNA, 697 bp, Homo sapiens
  misc_feature: GYAE6OF01DQV7T.27.78.H01.1.454.CMB.1.raw
  modified_base (519)..(519): a, c, t, g, unknown or other
  misc_feature (519)..(519): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccagcctccgaggggtgaaattgtgctgactcagtctccagtactttcagtctgtcgactaccgaaaaggagaaacgtccaaccactccgaccgtcggcccggggacctaggtacgaggaggtcggtttaggtagtacgtaccttacgacgttcggtaccagacgaaggaacgccgaaggtcacggttacctaccgaaacgtcctacctactaacgtactaaagttgtaccgtcccttacccgtacgtttccctttccgtaccggtacccggggttccccctacgggtacgggtttccgacgggtcggacgtaggtacgggtactcggtaccgggaactaccttacgtttaccaccctacacctatacaagtacgcgtaggacncgtagagtactgctgactacttattactacgtctatacgagtacgttacttactttactacgtacgtatactcgtaaccgttacggaaccgtaacggtaccgacggtaacgtaacggaacgtaacgttaaacggtacgtcggtacgaccgtacgacctaactcgttctacgtttaccc

SEQ ID NO: 171133 - DNA, 688 bp, Homo sapiens
  misc_feature: GYAE6OF01CEGN3.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtagaattgtgctgactcagtctccagactttcagtctgtgactaccgaaaggagaaagtcaccatcaccgtgccgggccagtcagagcgttggtagtagtcttacactaggtaccagcagaagccaggtcagtcctaccgaagtcctcctacatacaagtactacgtccttcccgtacgtccctttcgtacccgtaccggggttccccctacggtaccggtttcgacggttcgggactaaggttcggtagttaccgtacggggtaactacgttaccgtttacccaccccttaccctaaccctaactactaaacgtaacggtacccgtagggaaaccgtacgtaggtaacgtacgtacggtacctacgtaacccttaaactttacttaccgttcgtactaactacgtaacgtaacgttaccttaaccttacctaacgtaagttcgtattacccgtaccgttaccggaaccgaacgggtaccgacgtaacgtaacggtagtaaacgttaaaccg

SEQ ID NO: 171134 - DNA, 664 bp, Homo sapiens
  misc_feature: GYAE6OF01A4ZZ7.27.78.H01.1.454.CMB.1.raw
  modified_base (148)..(148): a, c, t, g, unknown or other
  misc_feature (148)..(148): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcaggggtnaaattgtgctgactcagtctccagactttcagtctgtgactccaaagganaaagtcaccatcacctgccgggccagtcagagtcggttggtagtagcttacactggtaccagcagaagccaggtcacgtctaccaaagtcctacctcatacaagtatcgtccttccctacgttcccttcgtacccgtaccgggggttccccctcggtacgggtttcgaacggtcgggctaggtcggtatccggtagggacctactactttcccgacccttaccacctactactaactacggaccgtaggaacgtcgtagaacgtagtcgtacgtgtacctaactttacgttactcgtactactacgtaacgtacgttaaccttaacctttaccgtataacgtacgtactaccgtaccgttaccggaccgtaacgggaccgtaacggtaacgtagggaaacgttaacgttaaacggtacgtacggtaccggtactaccggacccacttaccgttcgttccgtttccg

SEQ ID NO: 171135 - DNA, 607 bp, Homo sapiens
  misc_feature: GYAE6OF01DMSKO.27.78.H01.1.454.CMB.1.raw
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactgtaccagcagaagccaggtcagtctaccaaagctcctcatcaagtntcgccttcccagttccttctcgtacgggtccccgtcggagttcgagtggcgagtgatcgtgggacactattccaccctccaccactacaagtacgccgtaggaacgtaccgtagaaagagttcgactgaccttaacttattactntcgtactacgacgttacgttacctttaaccgtttacctacgtaagttcgtactcccgtaaccgttccggaaccgtaacgggaccaacggtacgtaggtaaacgtaagtttaaaccggacttcggtacggtcacggtacccacctaacgttccgttggtttaccc

SEQ ID NO: 171136 - DNA, 798 bp, Homo sapiens
  misc_feature: GYAE6OF01CL1UF.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctcgtcggttccacgcctcgagggtagaattgtgctgactcagtcctccagtacttcagtctgtacgactaccgaaaggaagaaacgtaccaacctactacctaccgtcggaccgggaccgacgtacgaggtacggtacggttaggtacgtacgtaccttaacgacgtacggtaccgagacgaacggaacgaccgtacggtacgtacgtacctaaccgaaacgtcctacctactaactaacgtaacgttacgtaccgtaccctttacccgtaccgtttcccgttaccggttacccgggtacccgggttaccccggtacgggttaccggttacggtacgggttcggtaccggtaggtacggttacgtaccgggtaccggtaacctaaccgttaacctttcccccgaaccccttaccaaacccctacgttaaccgtaaacggtcccggtaaccgggtaggtaacgtaccggtaagtaacggtaacgtttcggaaccttacgttaaccttaaacgttttcgtaaccgttagtactacttaacgtacgtaaccgtttaccttaccgtaaccgtagtaacgtctaccttaccgtcccgtaggaacccgtaacggacgttaccgagtaacggaagttaaaccgtaacgg

SEQ ID NO: 171137 - DNA, 769 bp, Homo sapiens
  misc_feature: GYAE6OF01EPJQY.27.78.H01.1.454.CMB.1.raw
  modified_base (670)..(670): a, c, t, g, unknown or other
  misc_feature (670)..(670): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcagttgggtttctgctgctcgtcgggttccagcctcgagggtataattgtgctgactcagtcctcagtactttcgagtctgtcgaactaccgaaaaggagtaaacgtccaaccgtactccgtaaccgtcgggaccccgggacctaaggtacgacggtaacggtcggtttaggtaaggttacgtaccttaacgaccgttacggtaccaggaccgaagaacgtaccggtacgtcgtaacggtacctaaccgtaaacgcccttacgtactacgttaacgtaaacgttcgttccgttaccctttacccgttaaccgtttccccgtttaccggtacccgggttaccccggggttaccccggttaggttaaccgggttccggtaacgggttccgggacggttaggtacggtacggttccggtacgggaaccctaccgtttaccgttaccctaccccgtactaacccgtaactacgtaaaccgtccgtaccgtaacgacgtacgtagaacgtgacgtctaactacttaactacttacgtntacctatactacgtacttaacttaccgttactagtacgtctacgtacctaccggtacgaaccgtacgaacgtacgtaagaacggtaataacggtaaacg

SEQ ID NO: 171138 - DNA, 650 bp, Homo sapiens
  misc_feature: GYAE6OF01D59Y9.27.78.H01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccggccagtcagagcgttggtagtagcttacactggtaccagcagaagccaggtcagtctccaaagcctcctcatcaagtatgccttcccagtccctttctcgacgggtcccctcgtaggttcgagtcggcaggtcggattccgagggactactactttccaccctccaccctatacaacgtacgccgtagggaacncgtagaagagtcgactgtaacccttaacgtttaacttacgttagttacctaacgtacgtaacgtaactttaacccgttaaccttttaccgtaaccgtaaggttacgtacgtttaccccgtacccggtttacccgggaaaccggtaaaccggggtaaaccctaaccggtaccggttaacgggtaacgttaaacgttaaaaacccggg

SEQ ID NO: 171139 - DNA, 514 bp, Homo sapiens
  misc_feature: GYAE6OF01EF00H.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccagtcagtctccaaagctctcatcaagtatgctccatccttctcagggtcccctcgagttcagtggcagtggatcgtgggacactatttccaccctcaccatcaatacgcctggaagctagaagatgctgctaacttattactgtcatcagtacgttactactttacctactagtgtactctaccgttcggaccaaggaccacgactaggaagtaacttaaagactggtgactcgccacatctgtcttacc

SEQ ID NO: 171140 - DNA, 894 bp, Homo sapiens
  misc_feature: GYAE6OF01D985Q.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggttggggatgagcaaaactgacaagtcaaggcaggaagatgttgccatcacaactcattgggtttctgcctgcctcttgggttccagcctccgaggggtnaattgtcgctagactcacgtctccagtactttcagttcgtgtgactaccgaaaggacgaaaacgtaccaaccagtccaccgtcggccgggcctagtcgagtacgtcgtttaggtacgtacgtacttaaccgtacgtcggtaccaggtaccaaggaaccgtacccgaagggtcctaacggttacctaacccgtaaaacggtcccttacctactaaacttcctaaaaggttcgtacggtacccttaccccgtaacgtttcccgttacgtcccgggtaaccggggttcccccgttacggtacggggtttaccgtaacgggtcggtaccgtacggtttacgggtaaccgttccggtacggggtaaaccctaaccgttaacgtttttccccgaacccccgttaccgaacccttaacggttacctaaaacggttacggtccccgggttaagggaaacccggttaccgtaagggtaaaccgtacgttacggttaccgtaacgttaaccgttaaaccgttttactttaacccgttacgtttaccgtaaaccgttaccgtaaggttaaccccgtttaccgttttaaccgttttacctaacggtttaaacgttaccggttaaccgttaccgttaacccgggtttaccgggaaccggtaacggtaccgtaacggttaccgtagggtaaactacgttaaacgggtactcggtacgggtactaccgtccgtaacttactaccggttgtccgttacccg

SEQ ID NO: 171141 - DNA, 680 bp, Homo sapiens
  misc_feature: GYAE6OF01EKNLM.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctacgaggggttaattgtgctgactcagtctccagtactttcagtctgtgactaccgaaaggagaaacgtcaccactcaccgtcggccgggccagtcagacggtcgttggtagtagcttacactcggtaccagcaagaacgccgaggtcagtcctaccaaacgcctccgtcactactaagtactcgccttcccacgttacccttcgtcggaccggggttcccctggtacggttcgacggtggtacgagtaggacttcggagggtacctaacgtctttaccaccctcaacctatacaacgtacgtaccgtagggaacgaccgttaggaacgtagtcgtaccgttacgaacgtttaaaccttatttaccgtagttacctattacgtagtaaccgtttaaccttaaccgtttaccctaactaagttaccggtaacttacccgaacccggtttcggaaaccgaacgggtaaccaacgggtacttaaacgggaacgttaacgttaaacgggtaaccgg

SEQ ID NO: 171142 - DNA, 680 bp, Homo sapiens
  misc_feature: GYAE6OF01ETJ0A.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatccaccgtgccgggccagtcagagcgttaggatagcttacactggtaccagcagaagccaggtcagtctccaaagctcctacatcaagtatgtccttcctagtccttctcgtacgggtcccctggacggttcgagtggcgtagtgatcgtggacacgtactttccaccctacaccctatactaaatacgacctaggaacgtcctagaaacggtactcggtaccgtacgtacctaaaccgttttaactttaccgtcgttacctacgttacctaaggtaaccgtttacttaacccttttacctacgtaaagttcgtaaccgttacccgtaacccggtttaccgggaacccgtaaaccggggtaccgaacggtaccggtaagggttaaacggtaaacgttaaaacgggtaccggttaggttaccgggtaccttaccggacctacccgttaacgttccttcggttccctttaacccg

SEQ ID NO: 171143 - DNA, 943 bp, Homo sapiens
  misc_feature: GYAE6OF01CKL17.27.78.H01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctcagactttcagtctgtgactacgaaagganaagtcacatcacctggccggccagtcagagcgttggtagtagtcttacacgtacggtaccagccgaaggaacgccgaggtccacgtacctaccaaagtcctaccgtactaattaccaaagttactcgtccctttaccccgacggtttcccttaccgttccggtaacccgggggtttccccctaggttaccgggttaccgtaggggttaccgggtaccgtaaggggttaccgggtaacgtttcgggttaaccggggggtaacccttaaaccgttaccgtttttaacccccgaaaccccccccgtttaacccgtaaacccccgttaaaccttaaacccgtaaaacggttaacccgggtaccccggttaacgggggtaaaacggtacccggttaaacgggtaaacgggttaacgtttacgggtacccgtttaacggttaaacccgtttaaaccgttttaaacgttttaaccccgtttagttacccgtaaacgtttaaccggtaacggtttaaaccgtttaaaccccgttttaaacccgtttttaaaccccgttaaccgttaaaccgggtttcgtaaccgtttaaccccgtttaaacccccgggtttaaccccggggtaaacccccgggtaaaaccgggggtaaacccggtaaaaccccggggtaaccgggtttaaaacggggtaaaccggttaaaaccggttttaaaaaacccgggg

SEQ ID NO: 171144 - DNA, 737 bp, Homo sapiens
  misc_feature: GYAE6OF01EJNFQ.27.78.H01.1.454.CMB.1.raw
tcagagcgtcgtctcacgaccggtgctcgatttagtgtgagtagtttgggttggggatcttaaaagaggttctttctctgggatgtggcatgagcaaaaactgacaagtcaaggcaggaagatgttgccatcacaactcattggtttctgctgctctgggttccagcctccgaggggtgaattgtgctgactcagtctccagtactttcagtctgtgactaccaaaggtagaaacgtaccccactaccaccgtcggccgggccgacgtacgacgagtcggttggtagtacgtacttacacgtcggtaccacgacacgacgaccgaggtacacttactaccacgcctacctacactactaagacactctccttccctacgtccgttcccgtcccgtacgggtcccgttccgtacggttcgtacgtaggtcgtacgtcggtacgtactacggtacctacctaccttacctaccctaccctaacctaacgtaccaaacgtacgaccgtacggtaacgtaccgtacgtaacgtaacgttacgtaacgttacgttaaccttaaccgtttaacgtttaacttacgttaacgtaacgttaaccgtaacgttaaccgtttaaccttaaaccgttaacccgttaccgtaacgtaccgttaccgttacccgtaacccgttaacccggtaacccgtaaaccgggtaaaccggtaaccggtaacggttaaacgggtaaacggtaaacgg

SEQ ID NO: 171145 - DNA, 558 bp, Homo sapiens
  misc_feature: GYAE6OF01E5A1C.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtggcagtgatcgtaggacactacttccaccctacaccatcaatacgcctaggaacgctgaagatgctgacctaattacttactgtcatcgtacgtagttacctactttacctactaacgtagtactaccgtaccgttacggacccgaaggaccgacgtacgtacggtaagtaacttaaaggacttcggtacgacttcgaccaactactcgttcgttccttaccg

SEQ ID NO: 171146 - DNA, 619 bp, Homo sapiens
  misc_feature: GYAE6OF01D1SRQ.27.78.H01.1.454.CMB.1.raw
  modified_base (320)..(320): a, c, t, g, unknown or other
  misc_feature (320)..(320): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaattgtgctgactcagtctccagactttcagtctgtgactaccaaaggagaaagtcaccatccacctgccgggccagtcagagcgttggtagtagcttacacgtggtaccagcagaacgccaggtcagtcctaccaaagcctcctcatcaagtatcgcttcccagtccttcgtcncgggtccccgtcgtaggttcgagtggcgatgggggggtatcgtgggacactactttccgaaccctccaccactactaaactacgaccgtcggaagtctagaagtatcgctacgtactaactttacttacttcgtactatactacgtaacgttaccttaccttttaacctactaagttacgtacttaccgtaccgttacggacccgaacggaacgtacgaccgtagggtaacgtaaacgttaaacggtaacgttcggtacgggtactacggtccaacctattccttcggttctttacccg

SEQ ID NO: 171147 - DNA, 768 bp, Homo sapiens
  misc_feature: GYAE6OF01ERU00.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggggtnaaattgtgctgactcagtctcagtactttcagtctgtgactaccgaaaggagaaagtcaccatccaccgtggccgggccagtcagagtcggttggtatagtcttacgactggtaccagcaaggacgccgaggtcagtctaccaagtcctcctacatacaagtatcgtccttcccacggttccttcgtcgtaccggggtcccctggtacggttcgaggtcggctaggtcggatcgtagggacctacgtacgtttccaccccgtcaccgtatacaacgtacgaccgtaggaacgtcgtaagaacgactgtactagtacctaaacgtttacttactcgttacaacgttacgtaagtaacctttaacctttaacctttaacccgtaacgttaacggttacgtaaccgtttacccgttaaaccccggtttaccgggaaccccggttaaaacggggtaacccgtaaaccgggttaaaccgggttaaacggggtaaaccgggtttaaaaaccgtttaaaaacccgggttaaccggtttcgggggttaaccccggtacgttaaccccgggtaacccttaacccgttaacgttttacccggtttaccggtttaacccttttaaccccgg

SEQ ID NO: 171148 - DNA, 590 bp, Homo sapiens
  misc_feature: GYAE6OF01EYW1E.27.78.H01.1.454.CMB.1.raw
tcagagcgtcgtctcacgaccggtgctcgatttagtgtgagtagtttggttttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgctcccagtccttctcgacgggtcccctgaggttcagtggcagtggatcgtagggacacgtactttcaccccttcaccctatcaaatacgcctaggaacgctaggaacgagtcgactagactaaactttacttactgtactatacgagtaacgttaacttacctttaacctacaagttcgaacttaccaccgtttacggaccgtaaacgggactaaccggactagggtaacgacgtttaaaacgaacgttggtacggctacgtaccacccgtaattcttcgtctttaacccg

SEQ ID NO: 171149 - DNA, 651 bp, Homo sapiens
  misc_feature: GYAE6OF01CLDOR.27.78.H01.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (488)..(488): a, c, t, g, unknown or other
  misc_feature (488)..(488): n is a, c, g, or t
  modified_base (637)..(637): a, c, t, g, unknown or other
  misc_feature (637)..(637): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgtgctgactcagtctcagtactttcagtctgtcgactacgaaagganaaagtcaccatccaccgtggccggaccagtcagagtcgttggtagtacgtcttacgacgttcggaaccagcaagaacgccaggtcagtcctaccaaagcctcctacatcgtaacgtatcgtccttccctacgttcccttcgtaccggtcggggttccccctaggtacggttccgacggtcgtacgaggtaggacgttcggtacgggtaacctacgttactttcccgaacccctctaacccgtacttacgtaactacggaccgtaaggaacgctagaacgtagcgtacgtntaaccttaatttacgttactgttacactactaagtacgtttacttacctttactacgtagtacgtacttccgtaccgttacggacccgaaggaccacggtacgtaggtaaacgttaagtaaccggtacgtggtacgtcgtacacacttntcgttctcgttacc

SEQ ID NO: 171150 - DNA, 673 bp, Homo sapiens
  misc_feature: GYAE6OF01A0TG6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcatcgggtttctgctgctctgggttccagcctccaggggtgaaattgtgctgactcagtctccagactttcagtctgtgactaccaaaggacaaagtcaccatccaccgtgccgggccagtcagagtcgttggtagtagcttacacgtggtaccagcagaacgccaggtcacgtcctaccaagcctcctacactacaagtactcgcctttcccaggttcccttcgtccgtaccggggttcccctaggtacggttcaggtcggctaggtcggatcgtacggactacgtactttccgacccttcgacctatacaaacgtcgcgtaggaactaccgtagaagtgtcgacgtacgtacttaactttacttacgtagtactacttacgtaacgttaacgttaccttaacgtttacctaacgtaacgttcgttaccttacccgttaccggttaccgggaaccgttaacggaaccgttaccggtacggtacgggttaaacgtaaacgttaaaccggacggttacggtaccggtacgttacgaccctacgttaacgttccgttacgttccgttacc

SEQ ID NO: 171151 - DNA, 916 bp, Homo sapiens
  misc_feature: GYAE6OF01DJ0Q9.27.78.H01.1.454.CMB.1.raw
  modified_base (193)..(193): a, c, t, g, unknown or other
  misc_feature (193)..(193): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcaacaactcattgggtttctgctgctcgtcgggttccacgcctcgaggggtagtaattgtnctgactcacgtctaccagtactttcagtctgtacgacctaacgaaaggagaaacgtcaccactaccaccgtcgggaccggaccagtcgacggagtcggttaggtagtactactaccacgtacggtaccagacgaacggaacgccgtaggtacacgtaccaaccaacgcctacctacaatactaagttacgtccgtaccttaccctaaccgtttccgttacggtacccgggtacccgggtttaccccgtacggttaacgggttttaccgagggttaccgggtacggttacgggttacgggtaccgtttacgggaaccggggtaacctaacccgtttaaccgtttaccccacccccttaactaaccctaacgttaaacccgtaaggtaccggtacggtaacggtaaacgtacgtaaagggtaacgtacgttaacgtccgttaaccgttaacgtttaaccctttaacgtttaacccgttataaaccccggttaaagttaacccgggttaacgtaaacccgttttttaaaccctttaacccgtttaaaacccggttaaacgggttaacgtttttaacccggaaacccctttttacccccgggttaaaccggtttaccccgggggtaaaaaccccggttaaaaccggggtaaacccgtaaaacccggggtttaaaccggtaaaaccggggtttaaaaacggttaaaacccgggttttaaaaccccggg

SEQ ID NO: 171152 - DNA, 752 bp, Homo sapiens
  misc_feature: GYAE6OF01A5DQE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacacgtggtaccagcagaagccaggtcagtcctccaaagcctcctcatcaagtatgccttcccagttcccttctccgacggggttcccctcggtaggttcaggtggcaggtggactcgtggacactactttccaccctcacctatacaatacggcccttagggaacgtccttaggaagtacttcggaccgtacgtaccttaaaccgttttaagtttaacccgttaggttaccctaattacccgtaaaggtttaaccgtttaaaccccgttttaaccgtttttaacccccgttaacgttaaacggtttaccggtaaccgttttacccgttaacccccggttttacccggggaacccccgtaaaacgggggtaaccctaaacccgggtaaaccggttaacgggtaaaacggttaaccggtttaaaaacggtaaccggtttacgggttaccgggtaccgttaccggacccttaaacccgtaacgtttacccgttcggttttccctttaaccccg

SEQ ID NO: 171153 - DNA, 762 bp, Homo sapiens
  misc_feature: GYAE6OF01B6YZV.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaaggcaggaagatgttgccatcacaactcattgggtttctgctgctctgggttccagcctcgaggggtgaaattgtgctgactcagtctccagtactttcagtctgtgactaccgaaaggagaaacgtcaccatcacctcggccggccagtcaggagtcggttaggtaggtacgtcttaacacgtcggtaccagtacgaggaacgccgaggtcacgtcctaccaaacgcctcctcaatacaagtatcgtccttacccgtacgttccttccgtaccggtaccgggttccccgtcggtacggttcgtacggtcggacgtaggtcggtagttaccggtaggggtaacctaccgttaactttaccccgtaaccccttacccgtaaccctaacgtaaccgtaaacgttaaccggtccgttacgggaaaccggtacgtaacgtaaaggtacgtacggtacctacggtaaccttaacgtttaacttacgttacgttacctaattacgtaagtaaccggtttaacctttacccgtttaaccttaacgtaacggttacgttaccttacccgttaaacccggttaccgggtaaaccgtaaaccgggtaaacccgtaaccggtaacggtacgggtaaaacgtaaacggtttaaaaacccggg

SEQ ID NO: 171154 - DNA, 694 bp, Homo sapiens
  misc_feature: GYAE6OF01DWO4Q.27.78.H01.1.454.CMB.1.raw
  modified_base (312)..(312): a, c, t, g, unknown or other
  misc_feature (312)..(312): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaattgtgctgactcagtctccagtactttcagtctgtgactaccgaaaaggagaaacgtcaccatcacctcgcccgggccagtcagagtcgttggtagtagtcttacacgtggtaaccagacagaagcccaggtcagtctaccaaagcctcctcatacaagtntcgccttccagttccttcgtcgacgggtccctcgtaggttcaggtgacgacgtgggactcgtgggaacctacgtactttaccaccctacaccgtacttaccaaattcggacctacgggaacgtacttaggaaaggtctacggctacggtaccttaaacgttttacttaacgttacgtacctaagttccaaaggttaccttaactttaacccgttttaacctacgtaaagtttcaacgtttccgaacccgtttaccgggaaccctaaacggggaaccacgggtaacgtaggggtaaacgttaaacgtttaaaaccggtgttaaccggggtcgtaaccgttacggtaacccctacccgttaacgttccgttccggttttaaccc

SEQ ID NO: 171155 - DNA, 549 bp, Homo sapiens
  misc_feature: GYAE6OF01BKPA2.27.78.H01.1.454.CMB.1.raw
  modified_base (509)..(509): a, c, t, g, unknown or other
  misc_feature (509)..(509): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgtccttcccagttcccttcctcgacggggttcccctcggtacggttcaggtcggctaggtggatcgtgggacactactttccaccctcacccatacaatacgccgtaggaacgctagaagatcgctgactaacttattactgtacatcagtagtacttactttacctactaagtgactcnccgttcggaccaacgggacacgacgtggaagtagtaaacg

SEQ ID NO: 171156 - DNA, 565 bp, Homo sapiens
  misc_feature: GYAE6OF01CF5LH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcggttggtagtagcttacacgtggtaccagcagaagcccaggtcagtctccaaagctcctcatcaagtatgccttcccagtccttctcacgggtccctcgaggttcagtggcagtggatcgtgggacacgtctttccaccctcaccatacaatacgcctaggagcctgaacgagtgctgactaacttattacttgtctaatcaagtattacgttaactttacccttactaagtcgtaatcctaccgttcgggacctaacgggactacggaacgtagggacgtaacgttaaacgaagttcggtcggtcgtacgaccacgtatcttcgttcttacccg

SEQ ID NO: 171157 - DNA, 702 bp, Homo sapiens
  misc_feature: GYAE6OF01BQP4N.27.78.H01.1.454.CMB.1.raw
  modified_base (484)..(484): a, c, t, g, unknown or other
  misc_feature (484)..(484): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgtaaattgtgctgactcagtctccagtactttcagtctgtgactaccaaaggagaagtcaccatcacctgccggcagtcagagtcgttggtagtagtcttacacgtggtaccagcaagaacgccgaggtcagtctaccaaagtcctcctacatacaagtactcgtccttacccgtagttcccttccgtaccggtaccggggttcccctaggtacggttaccgtaggtcggtacgtaggtggatcgtacggaactaccgtactttccaccctacacctatacaatacgccgtaggaactcgtagaatgtcgctacgactaacttacgttactgtacctanaccgtaagtaacgtttaaccttaacctttaccgtaacgtaacgttcgtaacgttacccgttaacccgttacggtaaccggaaaaccgggtacctaaccgggtaaaccggttaaacggggtaaaccgttaaaaccgtttaaaaccggtaaaccggttggttaaccgggtacctcgggtaaacccctaccgttactaccgtttacggttccttaaacccg

SEQ ID NO: 171158 - DNA, 697 bp, Homo sapiens
  misc_feature: GYAE6OF01A7Z5N.27.78.H01.1.454.CMB.1.raw
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttcagcctcgagggtgaaattgngctgactcagtctccagactttcagtctgtgactacaaaggagaaagtcaccancacctggccggccagtcagagcgttggtagtagcttacactggtaccagcagaacgccagtcacgtctaccaaagcctcctcatcaagtatgccttccgacgtccttcgtcgtaacgggtcccctacgtagttccgaggttcggcaggttcgggattcgtacggggacctacgtactttacccgaccccctacgaaccctaagtaccaaagtacggtacccgtaagggtaacgtccgtaggtaaagtactcggtaccgttacgaaccttaaacctttacgtttaaccgttacgttacctaagttccaacggttacgttaaaccgtttaccttttaaaccccgttaacgtaaaggtttccgaacgttacccttaacccggtttacccggaaccccgtaaagggtaaccccgttaaacggaacgtttaacggggaaccgttaaaggtttaaaaaccccggg

SEQ ID NO: 171159 - DNA, 667 bp, Homo sapiens
  misc_feature: GYAE6OF01DO2JV.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaaattgtgctgactcagtctccagactttcagtctgtgactaccgaaagggagaaacgtcaccatccaccgtcggccgggccagtcaggacgtcggttaggtagtacgtcttacacgtcggtaccagcagaacgccaggtcacgtacctaccaacgtctcctacatacaagtactcgtccttcctacgtccttcgtacgtaccgggttcccctacgtacggttcgcggtggcgtaggtggtactcgtacgggacctaacttctttacccaccccttacaacccgtataaccgaataccgaccgtaggaacgtcgtaaggaactcgtacggacttacgaacttaaactttacgtttactggactaagttacagttaacgttaccctttattacccgtataacggttctaaccttcgttaaaccccgttccgggaaccgaaacgggttaacctaacggacgttaagggtaaacgttaacgttaaaaccgg

SEQ ID NO: 171160 - DNA, 621 bp, Homo sapiens
  misc_feature: GYAE6OF01EY3AC.27.78.H01.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagctcctcatcaagtntgcttcccagtccttcncgacgggtcccctgacggttcaggtggcgagtggatcgtcggacactactttcaccctacacctatacaactacgccgtaggaacncgtagaagagtgacgtgtactaacttattactcgtanacttacgaacgtaacttaccttaacctttaaccgtactaacgttacgtaacttacctaacccgttaccggaaccgtaacgggaaccgtaaccgtaccgtagggtaaacgtaacgtttaaaaccggaaaccgttggtacggtaccgtacgtaccaaccctattacccgttgttaccccgtttaccg

SEQ ID NO: 171161 - DNA, 679 bp, Homo sapiens
  misc_feature: GYAE6OF01BJCIN.27.78.H01.1.454.CMB.1.raw
  modified_base (220)..(220): a, c, t, g, unknown or other
  misc_feature (220)..(220): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggtnagtcagagcgttggtagtagcttacactggtacagcagaacgccaggtcagtctaccaagcctcctcatcaagtactgccttccgacttccttacgccgtacgggttccccgtgtacggttcaggtcggactaggtgatcgtcggactacgtactttccacccgtacacctatacaaactacgacgttacggaacgtctaggaagtgtacgacgtacgtacctaactttaacgttactacgttacctaagttacgtaacgttaacgtttaacctttaaccgttttacccgtaactaaaggttcgttaaccgttaccctaacccggtttaccggaaccggtaacgggtaaccgtaaccggtacggttaacgggaaacgttaaacgtttaaaaccggtacggttacggacgggttactacggtaccctaaccttacgttccgttcgttacccgtttacccg

SEQ ID NO: 171162 - DNA, 632 bp, Homo sapiens
  misc_feature: GYAE6OF01EGSM9.27.78.H01.1.454.CMB.1.raw
  modified_base (200)..(200): a, c, t, g, unknown or other
  misc_feature (200)..(200): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtcctccagtactttcagtctgtgactaccaaagganaaagtcaccatcacctgccgggccagtcagagcggttggtagtagtcttaacacgtggtaccagacaagaacgccaggtcagtcctaccaaagctacctcatacaagtactcgtccttcccacgttccttctccgtaccgggtcccctaggtacggttcgagtcggacaggtggagtcgtacggactacgtactttccaccctacacccatactaactacgtcccgtaggaacgtctaaggaagtagtcgacgtagtaccttaaactttacttaccgtgtactagtacgtagtaacttaccgttactttacctaatacgtactacgttaccctaccgttaccggaccgtaacggacctaacggacgtagggtaacgtaaacgttaaacgacggttggtacgctacgaccactagttcttcgttccttacccg

SEQ ID NO: 171163 - DNA, 768 bp, Homo sapiens
  misc_feature: GYAE6OF01B51SP.27.78.H01.1.454.CMB.1.raw
  modified_base (304)..(304): a, c, t, g, unknown or other
  misc_feature (304)..(304): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgagggtgaaattgtgctgactcagtctaccagtacctttcagtctgtcgactaccgaaaggagaaacgtcaccatccacctgccggcagtcagagcgttggtagtagcttacacgtcggtaccagacgaagaacgccaggtcacgtctaccaacgcctcctanactacctaaggtactacgtcccttccctacgttcccttccgtccgtaccggggttccccctacgggtacggttacgtacggtcggtacgaggttcgggacttcggtacgggtaacctaaccgttacttttaccccgaaccccgtacctaaccaacgttaacctaaagttaccgggtacccgtaagggaacgtaccgtaaggaaacgttacgttcgacctacggttaacctaaaccgttttaattaccgtacggttactaacgtaccgtaaaggtaacctttaccgtttaaccctttttaacccgacgttaaacggttccgtaaccttacccgttaacccggttccgggaaccgttaaacggggaccctaacggtaaacggtacggtaaacgttaaaacgttaacccggtaaagttccggtaggtacccttacgaaccccttacgtaacttcccgttcgttaacc

SEQ ID NO: 171164 - DNA, 663 bp, Homo sapiens
  misc_feature: GYAE6OF01CH6NH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcacatcacctgccggcagtcagagtcgttggtagtagcttacactggtacagcagaagccaggtcagtctccaaagctcctcatacaagtatcgccttccacgttccttctccgtacgggtccctcgtacggttcgagtggcgagtggatcgtaggactactcttccaccctcacctataccaatacgtccgtaggaacgtcgttaaggaagtacgttacggtaccttacggtaaccttaaacttttaacgtttaaccgtagttacctaattacccgtaagttaacgttttaaccttaaccttttaaccctaacgttaacgttacgtacgttaacccgttaaccgtttacccgggaccgtaaacgggaacctaccggtaacgtacgggtaaacgtaaacgttaaaccggaacttggtacggtactacgtaaccctaccttattccttcggttccttacccg

SEQ ID NO: 171165 - DNA, 632 bp, Homo sapiens
  misc_feature: GYAE6OF01EW07O.27.78.H01.1.454.CMB.1.raw
  modified_base (150)..(150): a, c, t, g, unknown or other
  misc_feature (150)..(150): n is a, c, g, or t
  modified_base (616)..(616): a, c, t, g, unknown or other
  misc_feature (616)..(616): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtnaaattgtgctgactcagtctccagactttcagtctgtgactccgaaaggagaaagtcaccatcacctgccggccagtcagagtcgttggtagtagcttacactcggtaccagcagaagccaggtcagtcacaaagctcctcagtcaagtatcgcttcccaggtccttcgtacgacggggttcccctcggagtttcgaggttcggctagtcggatccgtaggacactacgttcaccctcaccatacaactaacgtccgtaggaactcgtagaacgtaatcgactacggaacttaactttagttaccgttgtactacttacgtaacgtattaacccgttaactttaaccctacgtaaacgttgtaaccgtacgtaccgttaccggaaccgtaaacgggacctacggaacgttacgggtaacgtaagtttaaaaccgtagtacggttagaccgttacggacaacccgtnttcccgtggtttaccc

SEQ ID NO: 171166 - DNA, 678 bp, Homo sapiens
  misc_feature: GYAE6OF01EG8L1.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtccaccatccacctcggccgggccagtcagagtcggttggtagtagtcttacacgtcggtaccagcagaacgccaggtcagtctaccaaagcctcctcatacgaagtactcggtccttcccgtacgttccttccgtacggtaccggggtcccctggtacggttcgaggtcggccgtaggtcggtacgtcggtacgggactacgtactttacccgaccctaccaacctactactaaacgtacgaccgtaggaacgtcgtaaggaagtacgttagcgtaacgtaacctaacttttaagttaccttcgtactaacgtacgtaacggttaacttaaccttaacctttaacctacgttaacgtcgtaccttaccgtacccgttaccggaccgtaacgggtaccaacggtacgtaaggtaacgtaaacgttaaacggtacgtggtacgtcgtacgtacctacacgttcttcgtcttacccg

SEQ ID NO: 171167 - DNA, 673 bp, Homo sapiens
  misc_feature: GYAE6OF01BHQEB.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaattgtgctgactcagtctccagtacctttcagtctgtcgacctccaaaggagaaagtccaccatccacctggccggcagtcagagcgttggtagtagcttacactggtaccagcagaacgccgaggtcagtcctacaaacgtcctacctcatccaagttatcgtccttcccgtacgttcccttcctccgtaccggggttccccctacggtacggtttccagggttcgggctaggtcggattccgtaggggaacctacttacctttccgacccctccacccgtaactacctaagtaccgccgtaggtaacgcctaggaacgagtcgactacgaccttaacttacttacgtacgttacacgttactaacgtaagttaacccgtttactttaacccgtacgttaacgtcggtaaccttaccgtaaccccggttaccgtaaccgggaaacggtaccctaacggaaccggttaggtaaacgttaacgttaaaaccggg

SEQ ID NO: 171168 - DNA, 745 bp, Homo sapiens
  misc_feature: GYAE6OF01DJC2K.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtagaaattgtgctgactcagtctccagtactttcagtctgtgactaccgaaaggagaaaacgtcaccatcaccgtgccggcagtcagagtcgttggtagtagcttacacgtggtaaccagcgaagacgccaggtcagtcctacaagctcctacatacgaagtatcgtaccttacccgagttccctttacgtccgtaacggggtcccctacggtagttccgaggtcgacgtagtacggacgttacgtacgggaactaaccgtactttacccaaccccgttcgaaccctaataccgtaaagttacgcccgttagggaacgtccgttaaggaagaacgttcgaccgttaacggtaaccttaaacgttttacgttaaccgttgttaaccgaatttaccggtaacgttaacgttaacctttaaccgttttaaacccgtagtaaacggttcgtaaccttaccgtaacccggtttaccgggaccgtaaacgggtaaccgtaaccggtaacgttacgggaaacgttaaacgttaaaaccgggacgtttcggtacgggtaccttaaaccggccttaaaccgtcgttttaccgttcggttaccctttaccg

SEQ ID NO: 171169 - DNA, 821 bp, Homo sapiens
  misc_feature: GYAE6OF01C9OPK.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctcagtactttcagtctgtgactaccaaaggagaaagtcaccatcactgccgggcagtcagagcgttcggtagtagctacactggtaccagacagaagccgaggtcacgtctaccaaacgcctacctcactacaaagtctcgtccttaccctacgttcctctccgtacgggtcccctcggtaggttccaggttcggaccgtaggtacggacttcgtcgggtaactacgtacttttacccaccccttacaaccgtacttaaccgtaaacgttaaccgggtacccggtttacgggaaacggtccgttaacggtaaaacggtaccgttacgggtacccttacggttacccttaaacgtttttacgtttaaccgtttcgttaaccgtaacgttaccgtaacggtttaaccgttaaccctttttaaccgtttttaaccctaaccggtttaaaacgttaccggttaaccctttaacccgttaaccccggttttacccggggaaccccgttaaaaaccgggggtacctaaaaccccgggtaaacggttaaccgggtaaacggtaaaacccgttttaaaacgggtaacccggtttacgggtacgggttacccgttaacggtaacccttacccgttaacgtacccgttttccgtttaacccgg

SEQ ID NO: 171170 - DNA, 778 bp, Homo sapiens
  misc_feature: GYAE6OF01BKBZ6.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatcacctgccgggccagtcagagtcgttggtagtagcttacactggtaccagacaagaacgccaggtcacgtcctaccaaagtcctacctcactacgaagtactcgtccttcccacgttccttcgtcgaccgggttcccctcggtaggttcaggtcggtacgtaggttcggacgtcgtacgggacctaacgtactttaccccgacccttaccaacccgtaacttacctaaagttaccgacccgttagggaacgtaccgtaaggaaacggtatacggtacttacggaaccttaaaccgtttacttaacgttacgttaccgtaattaccgtaacgttaacgtttaaccctttaaccgttttaacccaggttaaacgtacgttaaccgttacccgttaacccggttacccgggtaaacccggtaaaccgggggtaacctaaccggtaaacgggttaacgggtaaaacgttaaaaccggtttaaaaccggaaaaccggttttgggtaaaccggggtaccttaaccggaaccccgttaaacctaccgttttacccggttacgttttacccccg

SEQ ID NO: 171171 - DNA, 673 bp, Homo sapiens
  misc_feature: GYAE6OF01EBMH1.27.78.H01.1.454.CMB.1.raw
  modified_base (507)..(507): a, c, t, g, unknown or other
  misc_feature (507)..(507): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatcaccgtcgccgggccagtacagaggtcggttggtagtagtacttacactggtaccagcaagaagccaggtcacgtctaccaaagtcctcctcactacaagtatcgtcccttccctacgttcccttacgttccgaccggggttacccctcggtaacggtttccgaggtcgggactagggtaggtaacgtcggttacggggaacctaactacgttttcccaaccccgttcctaaccctactactaaacgtacgccgtagggaacncgtacgaagatcgctagacttaacttaacgttacctgtacgtatacgtaacgttacttaaccttaaccgttttaccaacgttaacgggtctaacttaccgtacccgttacgggacccgaaacgggtccgtaaccggaggttaacggaagtaaacgttaaaaccggg

SEQ ID NO: 171172 - DNA, 762 bp, Homo sapiens
  misc_feature: GYAE6OF01B80R8.27.78.H01.1.454.CMB.1.raw
  modified_base (288)..(288): a, c, t, g, unknown or other
  misc_feature (288)..(288): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctgccggcagtcagagcgttggtagtagcttacactggtaccagcagaagccaggtcagtcctaccaaagcctcctnatacaagtatcgccttacccacgttccttccgtaccgtacggggttccccctcggtacggttcagggtcggaccgtaggtcgggtaacgtccggtacggggacctaaccgtacgtttttaccccaacccccgttacccgaaccccttaaagttacccgtaaaacgttaaccggtaccccgttaaggggaaaccgtaccgtttaagggaaacggttaagttccggtaccgttaacgggtaaccttaaaaccgtttttaacgtttaaccgtttacggttaccttaacgttaccgtaaggttaaccgtttaaccctttaaccgttttaacccgtaacgttaacggtacgttaaccttaccgtacccggtttaacggaccggtaaacgggtaccaaccggtacgtaacgggtaacgtaaacgttaaacggaacgttggtacgtccgtacgaccctacgtatcgttacgttcttacccg

SEQ ID NO: 171173 - DNA, 659 bp, Homo sapiens
  misc_feature: GYAE6OF01AN9TB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaagtcacatcacctgccggcagtcagagcggttaggtagtagcttacactggtaccagcagaagccaggtcagtctaccaaagcctcctacatacaagtatcgtccttcccacgttccttctccgtacggggtcccctacggtacggttcgaggtcggcgaggtggaacttcggtagggaacctaaccgtactttaccaccccgtacaaccctataccaagtacgaccgtacggtaacgccgtaggaagtacgtacgtcgtacgtaacttaaacgtttacgttaactcgttacctaacgtacgaacgttaacgttaacctttaacgtttacctacgtaacgtagtaccttaccgttacccgttacggacccgaaagggtacccgaacgttaccgtaaggtaacgtaacgttaaacgtaacgtggtacgtactcgtacctacgtacttcgtgttccttaccg

SEQ ID NO: 171174 - DNA, 687 bp, Homo sapiens
  misc_feature: GYAE6OF01AJZEO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaagtcaccatcacctcgccgggcagtcagagtcgttggtagtagcttacacgtggtaccagcagaacgccaggtcagtctaccaaacgtcctacctactactactaagtatcgtccttcccgtacgttccttctaccggtaccggggttcccctcggtacggttcgtacggtcggacgtaggtggtacgtcgtgggaacctacgtactttaccaccctaccaccctaatactaacgtacgtaccgtacggaacgtcgtaggaagtacgtcgtacgtacgtaacctaactttacgttacgttagtacctaagtacctaagttacgttaacctttaaccttttaaccgtacgtaacggttactaccttaccgtacccggttaccggaccgtaacgggtaaccgtaccggtaagtaacggtaacgtaaaacgttaacggtaacgttcggtaccggtactacggtaccctacgtattcgtcgtacgttaccg

SEQ ID NO: 171175 - DNA, 670 bp, Homo sapiens
  misc_feature: GYAE6OF01BBDVQ.27.78.H01.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggnaaagtcaccatcacctgccgggcagtcagagtcgttaggtagtagcttacactggtaccagcagaagccaggtcagtctcaaagctcncatcaagtatgcttcccagtccttctcgacgggtcccctcggaggttcagtggccaggtggatcgtgggacacgtatttccacccgtcacctatacaaatacggtacctaggaacgtcgtaggaagactacggacttaggaacctaaacttttacttacttaggtacctaataccgtaacgtaacgtttaacccttaactttttaacccgtacttaaacggttacgtacttacccgtacccgtttaaccgggacccgttaaagggggacctaaccgggtaacggttaacgggtaaaccggtaaacgtttaaaaccgggaacgtttacgggtaccgggtccgtaacgtacccgtacttaacgttcccgtttccgttccgtttaaccc

SEQ ID NO: 171176 - DNA, 636 bp, Homo sapiens
  misc_feature: GYAE6OF01D9RPL.27.78.H01.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (176)..(176): a, c, t, g, unknown or other
  misc_feature (176)..(176): n is a, c, g, or t
  modified_base (251)..(251): a, c, t, g, unknown or other
  misc_feature (251)..(251): n is a, c, g, or t
  modified_base (455)..(455): a, c, t, g, unknown or other
  misc_feature (455)..(455): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctcgaggggtnaattgngctgactcagtctcagtactttnagtctgtgactacgaaaggagaacgtccaacatccacgtcggccgggacacgtacagacgtcgttaggtagtacncttacgacgtacgtaccagacgaagaacgccgtaggtaccacgtacctaccaacgtcctctactagtactaagtactcgtcccttccacgttcctcgcggtccggtccctggtacgttacgaggtcgagtacggtagtacgtcgtggactaccgtacttccacctacgactatactaacgtgaccgtgtaacgcgtaagacgtntcgacttagtaaacttactttactactacggtatacgtacgtaaacgttacttaccttaactacgttacgaacgtttacacgttacccgttaccggcggtaacgacggtacacggtacggtaagtaagtaaccttaggtcgtgcggtactcgtaaccgtctactttcgtccgttctacccg

SEQ ID NO: 171177 - DNA, 641 bp, Homo sapiens
  misc_feature: GYAE6OF01D59X9.27.78.H01.1.454.CMB.1.raw
  modified_base (180)..(180): a, c, t, g, unknown or other
  misc_feature (180)..(180): n is a, c, g, or t
  modified_base (507)..(507): a, c, t, g, unknown or other
  misc_feature (507)..(507): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtgactccaaaggagaagtcacatcacctgccggcagtcagagcgttggagtagcttacactggtaccagcagacgccaggtctagtcctaccaaagtcctcctcaatacaagttatcgtccttcccacgttcccttcgtcgtaccggggtcccctggtacggttcagtcggacgtaggtcggacttcgtagggtactactactttacccaccctaccaaccgtatacgaagttcgaccgtagggaacgcgtagaacgtatggactacgtaacttaacgtttacttacgtnttacctacgtacgtaacgtaactttaaccttacctttaaccctagttaaacgtacgtaactacccgttaccccgttaccgggaaccgaaacgggaacctaacggtaccgtaacgggaaagtaagttaaaaccgg

SEQ ID NO: 171178 - DNA, 693 bp, Homo sapiens
  misc_feature: GYAE6OF01CHMEV.27.78.H01.1.454.CMB.1.raw
  modified_base (338)..(338): a, c, t, g, unknown or other
  misc_feature (338)..(338): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggttctgctgctctgggttccagcctccaggggtgaaattgtgctgactcagtctccagtactttcagtctgtgactaccaaaggagaaagtcaccatcacctcggccggcagtcagagtcggttggtagtagacttacactcggtaccagcagaagccaggtcacgtctaccaaacgcctcctcatacaagtntcgtccttcccgattccttctcgaccggggtcccctgtacggttcaggtcgacgtaggtggactcggtgggaactactactttccaccccctacaccctaactacctaaacttacgaccgttagggaaacgtcgtaaggaagtacgtcggtaccgtaggtaacccttaaaccgttttatttaaccgttacgttacctaattaccgtaagttaaccggttaaccctttaaccttttaaaccctaacgttaaacgttacgtaacgttacccttaacccggtttaccgggaacccgtaaaacgggtaacccggtaacggtaacgtacgggtaaaacggtaaacgtttaaaaacccggg

SEQ ID NO: 171179 - DNA, 719 bp, Homo sapiens
  misc_feature: GYAE6OF01CHS6P.27.78.H01.1.454.CMB.1.raw
  modified_base (553)..(553): a, c, t, g, unknown or other
  misc_feature (553)..(553): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgtaggggtagaaattgtgctgactcagtcctccacgtctttcgagtcttgtcgacctaaccgaaaggaagaaacgtaccaaccactccaccgtcggccgggccagtcgagagtcggtttggtagtagtaccttacgactacggtaccagacgaaggaacgccgacggtcacgtacctaaccgaaacgtcctacctacactacgtaagtactaccgtccttacccctacgttccctttccgtaccgggtacccgggttccccgtacgggttacggttcgtacggtcggacgtaggtacggtacgtacggtacggtacctaccgttacctttccccgaccctaccgtaaccctataacccgtaacgtacgtaccgtaggaacncgtaaggactaggtcagtactactaatttacttactccgtatactcgtaagtacttaaccttaccttacgtaacgtaacgttcgtaacccttcgttaacccggtacccgggaaacgtaacgggtaacccacggggtattacgggaaagttaaaccggttaaacggg

SEQ ID NO: 171180 - DNA, 650 bp, Homo sapiens
  misc_feature: GYAE6OF01D85ZN.27.78.H01.1.454.CMB.1.raw
  modified_base (178)..(178): a, c, t, g, unknown or other
  misc_feature (178)..(178): n is a, c, g, or t
  modified_base (489)..(489): a, c, t, g, unknown or other
  misc_feature (489)..(489): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctggttccagcctcgagggtnaattgtgctgactcagtctccagtacctttcagttctgtcgactaccgaaaaggtagaaagtccaaccatccaccgtcggccgggccagtcaggacgcggttggtagtagccttacacgtgtaccagacagaacgccgaggtcagtcctccaaagcctcctacatacaagtactcgtccttcccacgttcccttcgtcccgtaccggggtcccctacggtacggttcgacggtggacgtaggtggtacgtcgtacgggacctacttactttcccaacccctcaaccctatactaactacgccgtaggaacncgtacgaagtgtacncgtacgtaaccttaactttactttactacgttactaattacgagttaacttaccctttaactttaacctagtaagtactacttacccgtacccgttccggaacccgaaaggtacctacgaacgttacggaaagtacgttaaaacgg

SEQ ID NO: 171181 - DNA, 609 bp, Homo sapiens
  misc_feature: GYAE6OF01CXZW3.27.78.H01.1.454.CMB.1.raw
  modified_base (181)..(181): a, c, t, g, unknown or other
  misc_feature (181)..(181): n is a, c, g, or t
  modified_base (540)..(540): a, c, t, g, unknown or other
  misc_feature (540)..(540): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtanaaattgtgctgactcgagtcctccagtactttcagttctgtgacctacgaaaggagaagtcaaccatcaccgtcgccggcagtcagagtcggttggtacgtagtctacacgtcggtaccagcgaagaacgccgaggtcacgtcctacgaaatcctactcaatctaagtcgtctccgtccacgttcctaccgtcgaccggtccctagtacggttcaggtcgcgtagtgactacgtggacctcgtacttccaccctcactactacacgtacgcgtagacgcgtagagtacgtcactacgtaacttaacttacttacgtcgtaactactaacgtagtaaaccgttacttaccttaaccgtanaacgtctaatcccgtaaccgttcggaacccgaagggacctacggaagtacgtaaagtaacgtaaaccgg

SEQ ID NO: 171182 - DNA, 646 bp, Homo sapiens
  misc_feature: GYAE6OF01A9JA7.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcaacaactcattgggtttctgctgctctgggttccagcctcaggggtgaaattgtgctgactcagtctccagtactttcagtctgtgactccaaaaggagaaagtcaaccatcacctgccggccagtcagagcgttggtagtagcttacactggtaccagcagaagccgaggtcagtctacaaagcctcctcatcaagtatgcccttacctacgttcccttcgtccgaacggggttccccctacggtacggttcgaggtcgggcgtaggtggtacttcggtacggggtaacctacgttaacgttttcccaccccttaccgaaccctaactacgtaaactacgacccgtaggtaaacgtcgtaacggaagacttagccgttagaccttaaacttagttaccgtgttacattacgagtaacgtaaccttactttaacctacgtaagtcgttactacctacccgttaccggaccgtaaacggaccaacggtaccgtaggtaacgtaaacgttaaaccg

SEQ ID NO: 171183 - DNA, 555 bp, Homo sapiens
  misc_feature: GYAE6OF01AY17V.27.78.H01.1.454.CMB.1.raw
  modified_base (179)..(179): a, c, t, g, unknown or other
  misc_feature (179)..(179): n is a, c, g, or t
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtcctccagtactttcagtctgtgactccaaaggagaaacgtcaccatcacctggccggccagtcagagcgttggtagtagcttacactggtaccagcagaagccaggtcagtctaccaaagcctccnatcaagtactgccttccactccttcgtcgaccgggtccctcgtaggttcngtcggactaggtggactcggtagggacactactttccaccctcacccatcaatacgccgtaggacnctagaagatcgcgtacactaacttatactntactatacagtacgtacttaccttaccagtaagtctactcgtaaccttccggacaacggtacacgtactaggtaagtaagtaaacg

SEQ ID NO: 171184 - DNA, 641 bp, Homo sapiens
  misc_feature: GYAE6OF01BW7PJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtcaccatcacctggccggccagtcagagtcgttggtagtgcttacacgtggtaccagcagaagccaggtcagtcaccaaagcctcctcatctaagtactcgtcctccctagttccttcgccgtaccgggtcccctggtacggttcaggtcggacgtaggtcgagtcgtacggactactagtttacccaccctcacctataccaaagtcgaccgtaggacgcgtaggaacgtagtacgtcgttagtaaccttaactttacttaccgttgtacctagtacaaggtacctttaacgttactttaccgtataagtacgtaccttaccgtacccgttaccggaccgtaaacgggtacaaccgggtaaacgtagggaacgttaaaccgttaaacgacgttgggaccgttcaccggtaccacgtaattcgttcgttccttacccg

SEQ ID NO: 171185 - DNA, 802 bp, Homo sapiens
  misc_feature: GYAE6OF01BKJ2F.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgaggggtgtaattgtgctgactcagtctccagtactttcagtctgtcgactaccaaaggagaaagtccaccatccaccgtggccgggcctagtacgaggtagtcggttaggtacgtacggtacctttacgaccgttcgggtaccaggaccgaaggaacgaccgtagggtacctaggtcctacccgaaaacggccccttcctacaacttaccgtaaagttcttaccggtccctttaccccgacgtttcccttttacggtcccggtaccggggttcccccgtacgggtacggttaccgtagggtcggacgtacgggtgggtacgttaccggtacgggaacctacgttactttacccgaccctacacctacttaccaagtaccgtcgtaaggaacgttcgtacgaaagtcgtgtactacgtaaccttaactttacttacgttctacgtaacgtacgtaagtaaccgtttaactttaaccgtttaccgtacgtaacgttcgtaaccgttacccgtaacccggttaccgggaacccgtaaaggggtaaccgtaccgggtaaccggtaaaggttaaaccggttaaacgttaaaaccggtaccgggtacgttacccggggtccgttacgtacccttaaccgttaaccggttccttactttaccccggg

SEQ ID NO: 171186 - DNA, 829 bp, Homo sapiens
  misc_feature: GYAE6OF01DMWN9.27.78.H01.1.454.CMB.1.raw
tcagagcgtcgtctcacgaccggtgctcgatttagtgtgagtagtttgggtttgggggcatgagacaaaactgacaagtcaaggcaggaagatgttgccatcacaactcattgggtttctgctgctctgggttccagcctcgaggggtgaattgtgctgactcagtctcagtactttcagttctgtcactacgaaaggagaaacgtcaccatcaccgtgccgggccagtcagagtcgttggagtagtcttacacgtcggacagacgagaacgccgaggtcagtacctaccaaacgtctccttacatacgtaagttactaccggtccctttcccgtaccgttcccgtttccgtccggtaaccgggttccccccgtaggttaccgggttacgtacgggttcggacgtacgggtaggacgttcggtacgggtaacctaccttacctttaccccgaaccccttacaacctactaaccgtaagtacgtaccgttaggaacgtacgtaggtaagtacgttcgacgttacgtaaccctttaatttaacgttttacgtacgttaacgtaccgtttaacgtaacggtttaaccgttaacctttttaaaacccgtttacccgttaaacgtaacggtttaccgtaacccgttaacccggttaacccgggttaccccgggtaaacccgggaaaaccggttaccgaaacccgggttaaacgttaaacggggggttaaacttaaaaacccggtttaaaccgggtacgtttaccggggtccggttaacccgtaaccggtaacccccttaacggtttactttccccggttacgtttttaaccccg

SEQ ID NO: 171187 - DNA, 585 bp, Homo sapiens
  misc_feature: GYAE6OF01EFRUY.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcgaggggtnaattgtgctgactcagtctccagactttcagtctgtgactccaaagganaaagtcaccatcacctgccgggccagtcagagtcggttggtagtagccttacacgtggtaccagcagaagccaggtcagtctaccaaagcctcctcatcaagtntcgtccttcccagttccctttcgtccgtacgggggttccccctcgggtacggtttccgaggtcgggctaggtggaacttcgtagggactactacgtttccaccctacacccatacaatacgcctaggaagctagaagntgctagactaacttattactgtactatcagtacgttaccttactttaccacgtacgtcgtactccgtaccgttcggacgaacgggacacgacgtaggaacgtaacgttaacgacgttgacgatccgactactattcgtcgtcttaccg

SEQ ID NO: 171188 - DNA, 671 bp, Homo sapiens
  misc_feature: GYAE6OF01AY6P6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctggccgggccagtcagagcgttggtagtagcttacactggtaccagcagaagccaggtcagtctacaagctcctcatcaagtatgccttccacgtccttcgtccgtacgggtcccctcggtacggttcaggtcggcaggtcggtactcggtcggactactacgtttccacccttacaacctaagtcaaacgttacgccgtaggaacgtacgttaagaacgtagtacgtaccttacggtaaccttaaacccgtttattaaccgttacgtactacgtacgtaacgttacgttaaacctttaaccgtttaaccgtaacgtaacgttacgtaacttccgtaacccgttaccggaacccgtaacgggaaccctacggtacgtaacgggtaaacgtaaacgttaaacggtaacgttggtaccggtacgtaccgaacgtaaccaacttcgttacttcgtttaaccc

SEQ ID NO: 171189 - DNA, 627 bp, Homo sapiens
  misc_feature: GYAE6OF01AJA5U.27.78.H01.1.454.CMB.1.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
tcagagcgtcgtctcacgaccggtgctcgatttagtgtgagtagtttgggtttgggggcatgagcaaaactgacaagtcaaggcaggagatgttgccatcacaactcattgggtttctgctgctctggttccagcctccaggggtgaaattgtgctgactcagtctccagactttcagtctgtgactccaaaggagaaagtcaccatcacctgccgggccagtcagagcgttaggtagtagcttaacactaggtaccagcagaagccaggtcagtctcaaagcctcncatcaatatncttccagtccttctcgcgggtccctgagttcagtgctagtcgatcgtggaccatcttaccgaccctnacctatacaatacggccgttaggaaacgtcgtaaggaaacgtacgttcggacgttacggtaaccttaacgttttacgttaaccgtcggttaccaagttacctaaggttaacgtttaactttaaacccgttttaccacgtaaagttcgtaacctccgtaacccgttaccgggaccgtaacgggtaccacggtacgtacggtaaacgtaacgttaaacgacgttcgtaccggtctacggtacctaaccgtcttccgtcggttacc

SEQ ID NO: 171190 - DNA, 798 bp, Homo sapiens
  misc_feature: GYAE6OF01B5L7O.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaacgtcaccatccacctgccgggcagtcagagcgttggtagtagcttacacgtggtaccagcaagaacgccaggtcagtctaccaaagctcctcactacaagtatcgtcctttcccacgttccctttcgtccgtaccggggttccccctacgggtacggtttccgacggttgggaccgtaggtcggtaacgttccggtaggggaacctaaccgttacttttacccgacccccttaccaaacccctaataccgtaaaacttaccggtacccgttaaggggaaaccgtacggttaaggaaacggtaagttcggtaccgttacgtaaccttaaacttttaacgtttaaccgttcggttactaacgttacgtaacggttaacgtttaacccttttaacccgttttaacccttaacgtaaagttaccgttaacgtacccgttaacccggttaccgggaacccggtaaaccggggtaaccgtaaccggtaacgttaacggggtaaacgttaaaaccgttaaaaccgggtaaccgttcgggtaaccggtaccgttaccgtacccgtaaccgttaacgtttccgttacgtttcccgtttaaccccg

SEQ ID NO: 171191 - DNA, 603 bp, Homo sapiens
  misc_feature: GYAE6OF01DNRQF.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaagtcaccatcacctgccggccagtcagagcgttggtagtagcttacactggtaccagcagagccaggtcagtctaccaaagctcctcatcaagtatgtccttcccagttccttctccgtacggggttccccctcggtaggttcaggtggcgtaaggtggtactcgtgggactactactttcccaccctacaaccctataccaagtacgacccgtaggaacgcgtaggaaagtactgctacgacttaacttatttacgtgtcatcagtaccgttaacttacctttacctcgtaagtctacttccctaccgttccggaacccgtaagggacccaacggtacgtaggaacgtaaagttaaaccgagtacggtcgaccgttacgacctacctaactccgttgttaccc

SEQ ID NO: 171192 - DNA, 709 bp, Homo sapiens
  misc_feature: GYAE6OF01E4MBQ.27.78.H01.1.454.CMB.1.raw
tcagagcgtcgtctcacgaccggtgctcgatttagtgtgagtagtttgggtttggggagtgagacaaaactgacaacgtcaaggcaggaagatgttgccatcacaactcattgggtttctgctgctctggttccagcctccaggggtgaattgtgctgactcagtctccagactttcagtctgtgactaccgaaaggagaaacgtccaacccaattccacccgtggcccgggccaggtcaggagtccggtttggtagtagctttacgaccgttggtaacccagcaagaacgccgaaggtcagtctaccaaagccttcctcaatacaagttactcgtccttacccgacgtttcccttacgtccgtaccggggttcccccttgggtaacggtttcgacggttgggaccgtaggttacggtacgttcgtacggggtaacctaacttaccttttaccccaacccccttaccaaccctacttacctaaacggttaccgaccgttagggaacgtacgttaggaaacgtacgttcgactacggtacttaaactttaatttacgtcgtatacgtacaagttaacgtttaccttaacctttacaactagttcgtaacttccctaacggttccgaccgaaaggccgtacgtacggtaggaaagtaacgttaaaccgtagtcggtagtctaccgcctaccgattccgttcgtctttaccg

SEQ ID NO: 171193 - DNA, 713 bp, Homo sapiens
  misc_feature: GYAE6OF01CMBID.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgagggtgaaattgtgctgactcagtctccagtactttcagtctgtgacctacgaaaggagaagtcaccatccaccgtcggccggccagtcgagagtcggttggtagtagtcttacacgtacgtaccagcaagaacgccgaggtcagtcctaccaaagtcctacctcaactctaagtactcgtccttaccctacgttcccttcgtaccggtaccgggttccccctacggtacggtttccgaagggttccggacgtacgggtacggtacgttcggttaacggggtaaaccttaaacggttttacccaaccccttacccaacctaacgttaaccgtaaacgttaaccggaccgttagggaacgtacgtaacggaagtacgtcggtactacgttaacctaaacttttattaacgtgtactacgtataacgtagttacccttaactttaccctaagtaacgtacgtaaccttaccggtacccgtaccgggacccgaaaggtacccgtaacggtaacgtaggaaacgttaaacgtaaacgttaaacgg

SEQ ID NO: 171194 - DNA, 678 bp, Homo sapiens
  misc_feature: GYAE6OF01EOACT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaattgtgctgactcagtctccagtactttcagtctgtgactaccaaaggagaaagtcaccatcacctgccggcagtcagagtcgttggtagtagcttacacgtggtaccagcagaagccaggtcagtctaccaaagctcctcatcaagtatcgccttcctacgttccttcgtccgtacggggtcccctcggtacggttcgagtcggcgagtggatcgtggacacgtacttccaccctcacctataccaacttacgaccgtggaaacgtcgttaaggaacgtagtcgtcgttacgactttaaaccgtttagtttacttgtactacttacgtaacgttaacgtttaaccttaaccgtttaacctaacgtaacgtttacgtaacttacccttaacccggttccgggtaaccgaaacggggtaacccgaaccggtaaccggttaagggtaaacggttaaacggtttaaaaccggtacgttcgggtaacgggtacctacggtaccgtaaccttagttccgttacgtttctttacccg

SEQ ID NO: 171195 - DNA, 707 bp, Homo sapiens
  misc_feature: GYAE6OF01CUYNB.27.78.H01.1.454.CMB.1.raw
  modified_base (481)..(481): a, c, t, g, unknown or other
  misc_feature (481)..(481): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccagggtgaattgtgctgactcagtctccagtactttcagtctgtgactaccgaaaggagaaagtcaccatccaccgtcgccgggcagtcagacgtcggttggtagtagcttacgacgtaggtaccagcagaagccaggtcagtctaccaaagcctcctcatccaagtactcggtcccttacccacgtttccttccgtccggtacccggggttccccctacggtacgggtttccaagggttcggacgtagggttggacgttcggtacgggacctacctaccttttcccaccccttacgaacctacttacaacttcgacccgtaggaacgtacctaggaacgtnttcggactacgacctttaacgttacttactcgtactaacttacgaaggttaaccgtttaacctttaacccgtttaaccctagttaaacggttcgttaaccttacccgtaacccggtttccggaacccggtaacgggaccaccgggtaccgtaagggtaaacgttaacgttaaaacggaccgttggtaccggtcgtacgaccctagtacgttccgttcgtttacccc

SEQ ID NO: 171196 - DNA, 700 bp, Homo sapiens
  misc_feature: GYAE6OF01AMQBE.27.78.H01.1.454.CMB.1.raw
tcagagcgtcgtctcacgaccggtgctcgatttagtgtgagtagtttgggtttgggggcatgagcaaaactgacaagtcaacggcaggaagatgttgccatcacaactcattgggtttctgctgctctgggttccagcctcgaggggtgaattgtgctgactcagtctccagtactttcagtctgtgactaccgaaaaggagaaacgtcaccatccaccgtggcccgggccagtcagagcggttggtagtacgcttaacacgtcggtaccagcagaagccaggtcagtcctacaaacgctcctcatcaagtatcgtccttcccacgttccttcgtccgtacggggtccccctcggtacggttcacggtcggctaggtcggtagtcgtagggacacgtactttccgaccctcaaccgtactactaactacgccgttagggaacgtcgtacggaagtacgtcgtacgtcggtacttaacgtttattaaccgtgtaccctaagtttaccgaagttaaccggttaactttaaccctttaacccgtacgtaaacgttacgtactaacccggttacccgttaccgggaacccgtaaacgggtaccgaaccggtacgtaacgggtaacgtaaaccgtttaaacggaaccgttacgggttacggtaccgtacgtaccgtaaaccctacttccgttacggttttacccc

SEQ ID NO: 171197 - DNA, 824 bp, Homo sapiens
  misc_feature: GYAE6OF01AO8DI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctcgagggtgaattgtgctgactcagtctcagtactttcagtctgtcgactaccgaaaaggagaaacgtccaaccactccaccgtcggccgggcctagtcagaggtcgttaggtagtacgtacttaactacgtacggtaccagacgaaggaaccgccgtaaggtccacggttacctaaccgaaacgtcctccctactaacgtactaaacgttactccggtacccttaccccgtacgtttccccgttaccgtacccgggttaacccgggggttcccccttacggtaaccgggtttacgtacgggttacggacgttacgggtggtacgttaccgggtacggggtaaccctacgttacccgttacccctaacccctaccgacccgtttaactaacccgtaaacggttaaccgtaacccgttacgggtaaaccgtaccgtaacggtaacgttacggttacggaaccttacgttaaaccgttaaaccttttaaacgttcttttaacggtactaacgttacccgtaaggttaacctttaacccgtttaacctttaacccgttaacgtaacggtttaccgaaccgttacctaaccccggtttacggaaacccggtaacggaccggtaacgtaccgtaaacgggtaacgtaaacgttaaaaccgg

SEQ ID NO: 171198 - DNA, 624 bp, Homo sapiens
  misc_feature: GYAE6OF01AJGJM.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtacgactaccgaaaggagaaagtcaccatcacctcgccgggcagtcagagtcgttggtagtagcttacactggtaccagcagaagccaggtcacgtcaccaaagcctcctcatacaagtatcgtccttcccacgttccttctaccgcggggttcccctggtacggttcgaggtcggcgtaggtcggtagtcgtaggtactactctttccaccctcacctactacaacgtacgtaccgtaggtaacacgttagaacggtatacgtacgtacgtacttaaacctttacgtttacttacgttacagttactaacgtacgtttaaccttacctttacctaacgtaagtcgtactacctaccgttacgtaccgaacggtcacggtacgaggtaacgtaacgttaacgacttggtacgcctagtaccctactatcgttcgtcttacc

SEQ ID NO: 171199 - DNA, 704 bp, Homo sapiens
  misc_feature: GYAE6OF01EV6WX.27.78.H01.1.454.CMB.1.raw
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactacaaagganaagtcaccatcacctgccgggccagtcagagcggttaggtagtagtcttacactcggtaccagcagaagccaggtcagtctaccaaagctcctcatacaagtatcgtccttcctacgtccttctccggtacggggtcccctggtacggttcaggtacggcaggtgatcggtacggactactactttcccaccctaccacctaactactaactacgaccgtaggaacgtcgtaggaagtactcgactacgtacctttaaaacgttttacttaacgtacgttacacgttacgtaaagttaacggtttaacctttaacctttaaccttacgtaaacgttggtaacccttccgtaacccgttaccgggaaccggtaacgggtaaccgtaccgtaacgggttaacgggaaacggtttaaaacgtttaaaaccggaaaccgtttgggtaacgggtacccgttacgaacccgtaacccgttaagtttcccgtttaccgttaacgttttacccc

SEQ ID NO: 171200 - DNA, 910 bp, Homo sapiens
  misc_feature: GYAE6OF01E3B4J.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgtgctgactcagtctccagtactttcagtctgtgactaccaaaggagaaacgtccaccatccgaccgtcggcccgggccagtcaggagtcggttaggtagtacgtccttacgacgtcggtaccagacaggaacgccgaggtcagtcctaccgaaagtcctcctcaactacctaagtactcgtcccttccgtacgttcccttccgtccgaccgggttcccctggtacggttcgacggttcggacgtaggtcgtacgtcgtacgggacctaacttaccgttaccctaaccccgttaccctaacccgtaacttaccgtaaaacgttaacggtaccccgtttaaagggaaaccgttccggtaagggtaaacggtacgttaccggttaaaccgttaccggttaaacccgtttaaaaccttttttaacgtttaacccgtttaccggtttaaacccgtaaccgtttaacccgttaaaacggggtttaacccttttaaaccccgtttttaaacccggtttttaaccccttaaaaccggttaaacggttttaacccgggtaacctttaccccggtttaaacccggtttacccggggaaacccgggtaaaacccgggttaacccggaaacccggtttaacgggtaaacccggggttaaacggttaaaaaccgggttttaaacccggaaacggtttcgggttacccggtaacgttaacccggtaaccctaaccgttaaccgtttccgttaccgtttacctttaaccccgg

SEQ ID NO: 171201 - DNA, 658 bp, Homo sapiens
  misc_feature: GYAE6OF01BB6B1.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctaccaagcctcctcatcaagtatcgtcctccagtccttctcgtaccggggtcccctcggtacggttcgagtcggctaggtggacttcgtcgggacactatttccaccctacacccgtactactaacgtacgacccgttaggaacgtccgttaggaacgtagtacggaccttcggaaccttaaaccttttacgttaaccgttgttacctacttacgaacggtaacgttaaccctttaaccttttacccgtacgttaaacggttcgtaacttacccgtaacccgttacccgggacccgtaaacggggtaccctaaacgggaccgttacgggtaaacgttaacgttaaaaacccggg

SEQ ID NO: 171202 - DNA, 703 bp, Homo sapiens
  misc_feature: GYAE6OF01BQNJJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagtcgttggtagtagcttacacgtggtaccagcagaacgccaggtcagtctaccaaacgctcctacatacaagtatcgtccttccctacgtccttcgtccgtacgggtcccctcggtacggttcgaggtcggacgtaggtggactcgtcgggtacacgtactttccgaacccctccacctaactacaaacgttacggcccgtagggaacgtaccgtaggaagtagttcgtaccgttacggtaaccttaaacgtttactttaccgttcgttactacgttacctaaggttaaccttaacccttttaaccgttttaacccgttaattaacgggttacgtaaccgtttacccgttacccggtttacccgggaacccgtaacggggaaccctaacgggtaccggttaacgggaagtaaacgtttaaaaccggagttcggtacggtcctacggtacctaaccgtattccttgttccttaacccg

SEQ ID NO: 171203 - DNA, 738 bp, Homo sapiens
  misc_feature: GYAE6OF01B8E8H.27.78.H01.1.454.CMB.1.raw
tcagagcgtcgtctcacgaccggtgctcgatttagtgtgagtagtttggggtttggggatcttaaaagaggttctttctctgggatgtggcatgagcaaaactgacaagtcaaggcaggaagatgttgccatcacaactcattgggtttctgctgctctgggttccagcctccgaggggtagaaattgtgctgactcagtcctccagtactttcagtctgtagactaccgaaaggagaaacgtcaaccatcaccgtcgccggcctagcagagtcggttggtagtacgcttacacgtcggtaccagacgagaacgccgtaggtacacgtaccaccgaaacgtcctacctactaacgtactaaggttactcgtaccttccccgtacgttccctttaccgtaccggtacccggggttccccctacggtacggtttccgacgggttcgggacgtagggttggtaacgttccggtacggggtaaccctacgttaaccttttaccccaacccccgttaccaaacccctacgtaactaaacgttaccgtaccgtaggtaacgtccgtaagaagtacttcggacttacgtaaccgttaactttactacgtttacgtaactacgttactaacggtaacgtttaacccttaaccgtttaccgtaacgtaacgtactacgtcctaaccggtttacccggaacggtaccgggaacctaacgtacgtacgggaacgtaacggttaaaccgg

SEQ ID NO: 171204 - DNA, 569 bp, Homo sapiens
  misc_feature: GYAE6OF01CY2SA.27.78.H01.1.454.CMB.1.raw
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagagcgtcgtctcacgaccggtgctcgatttagtgtgagtagtttgggtttggggatgagcaaaactgacaagtcaaggcaggaagatgttgccatccaacgaacctcattggtttcctgctgctctgggttccagccctccaggggtgaaattgtgcctgactcagtctccagactttcagtctgtgactccaaaggagaaaagtcaccatacaccgtgccgggccagtcagagcgttggtagtagcttaacactggtaccagcagaagccaggtcagtctaccaaagctcctcatcaagtatcgccttcccagtccttctcgacgggtcccctgagttcagtgcagtgatcgnggacacgtacttccaccctcaccatcaatcgcctaggacnctagaacgtatgctagtactaacgtttattactgtacatacagtaactactttactttaaccctataagttacgacttcctaccgttccggaccgaagggaaccacgtacgtaggaacgtaacttaaacggacttggtacggactcgacctacctattacctgttcttaccg

SEQ ID NO: 171205 - DNA, 571 bp, Homo sapiens
  misc_feature: GYAE6OF01DST15.27.78.H01.1.454.CMB.1.raw
  modified_base (180)..(180): a, c, t, g, unknown or other
  misc_feature (180)..(180): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctctgggttccagcctccaggggtnaaattgtgctgactcagtcctccagtactttcagtctgtcgacctaccgaaaggaagaaagtccaccatcaccgtcgccggccagtcagagtcgttggtacgtagcttacactaggtaccagacaagaacgccgaggtcaacgtcctaccaaagtcctacctctaatacaaagtactctcttcccagttcctcgccgacgggtccctggtacgtcgagtgcaggtgacgtcgcggacgactactttccgaccctacaccactacaatacgcgtagaacgntagaactntgctacgctaattattactgtacatcagtacgtacttacttacctacagtctactacgtcctacgaccgaaggaaccgtagaagtcgaagtaacgtaaaccgg

SEQ ID NO: 171206 - DNA, 787 bp, Homo sapiens
  misc_feature: GYAE6OF01AGST4.27.78.H01.1.454.CMB.1.raw
tcagagcgtcgtctcacgaccggtgctcgatttagtgtgagtagtttgggtttggggtagtcttaaaagaggttctttctctgggatgtggcatgagacaaaactgacaagtcaaggcaggaagatgttgccatcaacaactcattgggtttctgctgctcgtgggttccagcctccgaggggtacaaattggtgctagctcagtctaccagtaccttcgacgttcttcgtcggaactaccgaaagggtaacgaaaacgttcaacctactacaccgtcggccggccgtacggtacgtacggtacgtccggtttaagggtaggttaacctaccgttacgtacgtacggtaaccgagaccgtaacggaacggtccgaacgggttcctacggtacctacccgaaacgtccttacccgactaacgtaacctaacggttattccggtacccttcctaacgtttcccgtttaccgcccggggttaccggggttcccctacggtacggttacgaccggtagtccggtaggtcgtacggccgttacggaccgtacttacgtaccctccgtacctaccgtactaactaccggacgtaccggtacggtaacgtacgtagtacgttacggacgtcgttaaccgtacgtaaccttaacgttacgttacgtacgttacgtacgttacgttaaccggttaactttaccgtttaacctaacgtacgttacgtacccttaacggtccccgttaggaacccgggtacgacgtaaccggtactacggtaaagtaacgttaaacgg

SEQ ID NO: 171207 - DNA, 586 bp, Homo sapiens
  misc_feature: GYAE6OF01C89YK.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgagggtgaaattgtgctgactcagtctccagactttcagtctgtgactaccaaaggagaaagtcaccatcacctggccgggcagtcagagcgttggtagtagcttacacgtggtaaccagaccagaagccaggtcagtctaccaaagcctcctcatcaagtatcgccttcccagttccttctctacgggttccctcgagtcagtgcagtggatcgtagggactacatttccaccctcaacccatacaatcgacctaggacgtctaggaagatgactgacctaacttattactgtcatcagtacttaacctttactttaaccgtacgtaagttcgtactaccgtaaccgttccggaacgtaacgggacgaccgacgttagggaacgtaagttaaacggacgttagggtacggacgtcgaacgtacccaagttcgttcgtttaccg

SEQ ID NO: 171208 - DNA, 569 bp, Homo sapiens
  misc_feature: GYAE6OF01EWFH8.27.78.H01.1.454.CMB.1.raw
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctggccgggcagtcagagtcgttggtagtacgcttacactcggtaccagcagaacgccaggtcagtctaccaaagcctcctcatacaagtatcgtccttccacgttccttcctcgtaccggggtcccctcggtacggttcgaggtcggcaggtcggtatcggtggactacgtatttccaccctacacctatacaagtacgccgtaggaacgtctagaagtagtgactagtactaaatttacttactntacatcagtacttctaacttcanacgtgactcgactcggacacggacacgtactggaacgtaattaaaccgacgttcgtaggcctacgtccaactnttcgtntccttaccg

SEQ ID NO: 171209 - DNA, 543 bp, Homo sapiens
  misc_feature: GYAE6OF01D4EP7.27.78.H01.1.454.CMB.1.raw
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgccttcccagtccttctccgacggggtcccctcgtacggttcagtggcaggtggagtcgtgggactactatttccaccctcaccatcaaatgcctaggaacgtctagaagtatcgctgactaacgtttattactgtcatcaagtattacctactttaccatagtntatccaccgttcggaccgaacggacacgacgtaggaacgtattaaacgacgtgagctacgacctacattcttcgtcttaccg

SEQ ID NO: 171210 - DNA, 671 bp, Homo sapiens
  misc_feature: GYAE6OF01EORN3.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccgaggggtnaaattgtgctgactcagtctcagtactttcagtctgtcgactaccgaaaggagaaacgtcaaccatccaaccgtcggcccggggacagtacgaggagtcggtttaggtagtagtcttacacgtaggtaccagcaagaacgccgaggtcagtcctacaaagcctactacactacaagtactgtcccttacctacgttccttccgtacgtaccgggtcccctaggtacggttcaggttggcgtaggtggactcgtagggaccacgttattacccgaccctcaacctactacgtaaatacgaccgtaggaacgtcgtaagaagtagtacgtacgtataacttaacgttatttacgtatactaacttacgaacgttacgtttaaccttactttaccgtaacgtaagtacgtacttaccgtacccgtttaacggaccgtaacggaacctacggtacgtaagggtaacgtaaacgttaaacgtacggtcggtacgtacgacgtactaacctattccgttcgtcttaacccg

SEQ ID NO: 171211 - DNA, 889 bp, Homo sapiens
  misc_feature: GYAE6OF01AQ7VA.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtcctccagtactttcagtctgtgacctccaaaggagaaagtcaccatccacctgccggccagtcagagcgttggtagtagcttacactggtaccagcagaagccaggtcagtactaccaaagcctcctcactcaaagtatcgtccttccccgtagtccctttccgtaccggtacccgggggttccccccttacggtaacgggttttaccgtaacgggttcgggggaccgtaaggggttacggggtaacgtttccgttaacggggggtaaccctaaccgttaacgtttttaccccaaaccccccgtttacccgaaaaccccttaacgtaacccgtaaacgttaaccgtaccccggtttaaggggaaaccgttacccggttaagggaaaggttaacgttccgggtacttaccggtaacccggtttaaacctttaactttttaaccgtacggtttaccctaacgttaccggtaaagttaaccggtttaaacccttttaaccccgtttttaaccccgtaacgttaaaccgggtttacgtaacccgtttacccgtttaaccccggtttaccccggggaacccggttaaaaccggggacccgtaaaacccggggttaaccgtaaacgggggtaacgtaaaaccggtttaaaaaccgggtacccgttacggggttacggtaccggttacccggaaccttaacccccgttagttccgttacggtttacccc

SEQ ID NO: 171212 - DNA, 737 bp, Homo sapiens
  misc_feature: GYAE6OF01CKLQR.27.78.H01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctggttccagcctccaggggtgaaattgtgctgactcagtcctccagactttcagtctgtgactccaaagganaagtcaccatcactgcggccagtcagagtcgtggtagtagcttacactgtacagcagaacgccaggtcacggtcctaccaaacgctaccctacgataccaagtatcgtaccttcccctacgttccccttaccccgtacggggtcccccctaggtaccggttacacggtcggccgtaagggttcggtaacttcggttacggggaacctaacccgttactttaccccgaacccccgtacctaaaccccataaccgtaaacgtttaaccgacccgttagggtaaacccgacgttacggtaaacgtacttacgggtaccttacgtaaccttaaacgttttaaccttaacgttcggttactaacgttaaccgtaaggttacgttaacctttaacccgtttaaccctaccgtaagtttcgtaacgttaccccgttacccgtttacccgggaacccgtaaacgggtcccgaaacggttaccggtaaggtaacgtaacgttaaaaccggtaaccg

SEQ ID NO: 171213 - DNA, 861 bp, Homo sapiens
  misc_feature: GYAE6OF01EHY1P.27.78.H01.1.454.CMB.1.raw
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaagganaaagtcaccatccacctggccggccagtcagagcgttgtagtagcttacacgtggtaccagcagaagccaggtcagtctaccaaagcctcctcatacaagtactcgtccttcccgtacgttcccttccgtacggtaccggggttcccccttggtacggtttaccgaggtcggcgtaacggttgggaacgttcgtacgggaactaccttacttttacccaacccctcaaccctactaacctaaacgttacggcccgtaggaaacggtcccgttaaggaaacggtaacttcgggtaccgttacgggtaaccttaaaaccgtttttactttaaaccgtttacggttacctaacgttaacccgtaaggggtttaaacccttttaacccttttaaaccccgttttttaaaccccgttaaccggttaaaaaccgggtttcgttaaaacccgtttaaccccccgggtttaacccgtttaaccccggggggtaaaccccggtaaaacgggggtaaaccctaaaccccgggttaccggttaaacgggggtaaaacgttaaaaccggtttaaaaaacccgggtacgggttacgggtttaaccggggtaccctaaccggtacccccgttaaaaccttccgtttacccgtttccggttcccgttttaaaccccg

SEQ ID NO: 171214 - DNA, 664 bp, Homo sapiens
  misc_feature: GYAE6OF01BM6HB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccgaaaggagaaagtcaccatccaccgtcggcccgggccagtccaggagtcggtttggtagttagtcttacacgtcggtaccagccgaagaacgcccgaggtccagttcaccgaaacgcctcctacatacgaactctacgtccttacccgtcttccgttcgtccggtaccgggtcccctcggtacggttcgaggttcggcgtaggtgacttcggtcggactacgttaccttccctaacccctcaacctatactaacgtcgccgtaggaactcgagaagtctgtacgtactaaccgtaactttagttaccgtagtaccacttacggaacttaacgtttaaccctttaccgtttaaccacgttaacgttacgtacttaccgtacccgtaccggacgtacggaaccgacgtacgaggtaaacgtaaacgttaaccggagttcggacgacgtcgtaccacgtaccttgtccttcgtacc

SEQ ID NO: 171215 - DNA, 665 bp, Homo sapiens
  misc_feature: GYAE6OF01B38EA.27.78.H01.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtgactcaaagganaaagtcacatcactcgccgggcagtcagagtcgttggtagtagcttacacttggaccagcagaagccaggtcaggtcctaccaaagtcctacctanactacaagtactgcctttacccgacgtttccttcgtaccggaccggggttcccctcgggttaacggtttcgaacgggttcggtacgtaggtacggtacgtcgtacgggactacgtctttaccacccttcaaccgtattaccgaattaccggaccgtagggtaaacgtcgtaaggtaaacgtcgtcgtacgtacgaacttaaactttacgttacgttgtacacttagaacgtagtttaaccctttatttaccctagtaacgtctaaccttaccgtacccgttacggaccgaacggactaacgtcggtaaggaaacgttaacttaaacggacgttggacggtactacggacttacctattcttcgttcttacccg

SEQ ID NO: 171216 - DNA, 613 bp, Homo sapiens
  misc_feature: GYAE6OF01C6S2C.27.78.H01.1.454.CMB.1.raw
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaaagtcaccatccaccgtgccgggccagtcagagcgttggtagtagcttacactggtaccagcagagccagtcagtctccaaagctcctcatacaagtatcgccttcccagtccttctccgtacggggttcccctcggtacggttcgacggtggactacggtggacgttacgtggggaactaacgtactttaccacccctcaacctactactaaactacgtcccgtaggaagtcctaagaacgatgtcgtagtaacctaactttacttacgtcgtactactctaagtacgttaactttacctttaacctacgtaagtgtaactccgtaccgttaccgggacaacgggtacaacgacgtaggaacgtaaagttaaacgacgtggtacgctacgacacctntactcgttnttaccg

SEQ ID NO: 171217 - DNA, 843 bp, Homo sapiens
  misc_feature: GYAE6OF01C9NNT.27.78.H01.1.454.CMB.1.raw
tcagagcgtcgtctcacgaccggtgctcgatttagtgtgagtagtttggggtttggggggcatgagcaaaactgacaagtcaaggcaggaagatgtgccatcacaactcagttgggtttctgctgctctgggttccagcctccgaggggtagaattgtgctgactcagtctccagtacttcgagtctgtacgactaccgaaaagggaagaaacgtacaccaactccaacccgtcgggacccggggacctaggtacgaggtacggtcggtttagggtacgtacgtaccttaacgacggtacggtaaccaaggacgaaggaacgtaccggtacggttccggtacctaaccgaaacgtcctacctactaacgtacgtaaagtcgtaccgtcccttccctacgttcctttaccgtaccggtacccgggttcccctacgggttacggtacggtaaggtcggtacggtaaggtcggtaacgtcggaacgggtaacctaaccttacctttacccacccttaccaaccgtaaactactaaacgtacgtaccgtaagggtaacgcaaggtaacggtactcgtacgtacttaacctttaaatttacgttaacgttcgtaaacctacgtaacggtaccggttaaaccttttaaaccctttaaacccgttttaccaaacggtaacgtaccggttaacctaccccggttaaccgggttaacccgggaacggtaaaccggggttaacccaaccgggttaacgtaagggtaaaacgtaaaaccgttaaacccgagggttcccgggtagccgttaacgtaaccccaaggttccgtttccggttaacccgtctttaaccc

SEQ ID NO: 171218 - DNA, 733 bp, Homo sapiens
  misc_feature: GYAE6OF01ERE2O.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtnaaattgtgctgactcagtctccagtactttcagtctgtgactaccgaaaggagaaaacgtccaaccatccaccgtgcccggacagtcagagtcggttggagtacgtcttacgactcggtaccagcgagacgccgaggtctacgtcctaccaaagcctacctacactacgaacgtatcgtccttaccctacgttccttccgtacccggtaccggggtcccctaggtacggttcgacgggttcggacgtacggtggacgttccggtacggggaacctaaccttacctttacccgaaccccttaccaacccctaagtacctaaagttaccggacccgtaagggtaaaccgtccgttaaggaacgtacgttacgtacgttacgtaacctttaaaccgttactttaacgtacgttactaacgttaccgtaacgtaaccgttaacctttaaccgtttaacctacgttaaacgttcgtaacttccgttacccgttacccggaaccgtaaacgggaacctaacggaacgttaacgggtaaacgtaaacgttaaacccggg

SEQ ID NO: 171219 - DNA, 723 bp, Homo sapiens
  misc_feature: GYAE6OF01BGANW.27.78.H01.1.454.CMB.1.raw
  modified_base (563)..(563): a, c, t, g, unknown or other
  misc_feature (563)..(563): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccctccgaggggtgaaattgtgctgactcagtcctccagtacctttcagtctgtcgaacctaccgaaaagggaagtaaacgtccaacccactccacccgtcggccccgggaccagtacaggtacgtacggtttggtaagtagtacttaacacgtcggtaccagcgaaggacgccgaggtcacgtcctaccgaaacgtcctacctacaactactaagttacgtcgtaccctttaccccgtacgttccctttccgtacccggtacccggggttccccgtacggtacggttcgacgggtcgacgtaggtcggtacgtcggtacgggactaccgttacttccccgacccctacacccctaatacctaaagtccgtaccgtaggaacgtccgtagaacgtntacgtctacgtacttaacttacgttacgtgtactacgtacgtacgtaaccgttaaccttacctttaaccgacgttaacgtcttaacccttccgtacccgttaccggaacccgaaacgggtaccgtacgtacggtaacggtaagtaaaccggttaaaccgg

SEQ ID NO: 171220 - DNA, 631 bp, Homo sapiens
  misc_feature: GYAE6OF01CAK7O.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagctcctcatcaagtatgccttcccagttccttctcgacgggtcccctcgaggttcagtgcagtggatcgtgggactacgtactttccacccttcaacctatacaaactacgccgtaggaacgtctaggaacgtagtagtcgtacgaacttaactttatttacgtacgtactattacaagtacgttaaccttactttaaccctaacgtaagttcgtacttaccgtaacccttacgggacctaaacgggacctaaccgggtaccgtagggaaacgtaaacgtttaaaaccggaacgttcggtacggggtaccttacggacctaaccgtatttccgttcgttacctttaacccg

SEQ ID NO: 171221 - DNA, 646 bp, Homo sapiens
  misc_feature: GYAE6OF01EBJNS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtgaattgtgctgactcagtctccagtactttcagtctgtgactaccaaaggagaagtcaccactcacctcgccggccagtcagagtcggttggtagtacgtcttacactggtacagacgagaacgccaggtctacgtctaccaaacgctcctcactacaagtactcgtccttcccgtacgttccctttctccgtaccggggtcccctcggtacggttcgaggtggcgaggtggtacgtcgtagggtaacactactttccaccctacacctaactctaaactacgccgtaggaacgtcgtaggaagtagtcgtactacgtactaacttttacgttactcgtactactcgtaacgtaacgtttaccttaccgtttaacctactaaggtcgtaacttccgtaaccgttccggacggaacggtaccgacggtacgtaagggtaacgtaaacgttaaaggtacgttcggtacggacgttaccgactacctattccttcgttcttaccc

SEQ ID NO: 171222 - DNA, 724 bp, Homo sapiens
  misc_feature: GYAE6OF01DWZL5.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgtaaattgtgctgactcagtctccagtactttcagtctgtgacctaccgaaaggagaaacgtcaaccatccaccgtcggccggccagtcagagtcggttggtagtacgtacttacacgtcggtaccagcgaacgaacgccgacggtctacgtcctaaccaacgtcctcctactaactacctaaagttatccgtccttaccctacgttccctttccgtacgtacccggggtccccgttcggtaacggttacgacggtcgggtacgtaaggtcggtaacgtcgtacggggaacctaacgttcctttaacccgacccctactaaccccgtaataacctaaacgtaccgtaccgggtaagtaacgtcgtaagaacgtagtcgtacgtcgtaaacttaactttaacttaccgtattaccgtacttaacgagttaaccttaaccttacttacccgtaataacggtctaacccttaccgtacccggttaaccgaccggtaaaccgggtactaaaccggtaggttacggtaaacggtaaacgttaaaacccggg

SEQ ID NO: 171223 - DNA, 678 bp, Homo sapiens
  misc_feature: GYAE6OF01B5CKK.27.78.H01.1.454.CMB.1.raw
  modified_base (217)..(217): a, c, t, g, unknown or other
  misc_feature (217)..(217): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtnactaccaaaggagaaagtcaccatcaccgtcgccggccagtcagagtcgttggtagtagcttacacgtcggtaccagcagaacgccaggtcagtcctaccaagtcctcctcatacgaagtactcgtccttcccacgttccttaccgtccggtaccggggttccccctacggtaacggtttccaagggtcggtaccgtaggtacggtacgttcgtacggggtacctaccgttaaccttttcccacccccgttacaaccctaactacgtaaactacgacccgtaggaacgtacgtagaacgtactcgactacgacctaactttattaccgttagtactactacgtagtaccgttaacttacctttaaccgtactaacgttctacgttacccgtacccggtttaccggaacccgtaacgggtacctaacggtaaccgtagggtaaacgtaacggttaaaaccgg

SEQ ID NO: 171224 - DNA, 713 bp, Homo sapiens
  misc_feature: GYAE6OF01CZZ2H.27.78.H01.1.454.CMB.1.raw
  modified_base (554)..(554): a, c, t, g, unknown or other
  misc_feature (554)..(554): n is a, c, g, or t
  modified_base (638)..(638): a, c, t, g, unknown or other
  misc_feature (638)..(638): n is a, c, g, or t
tcagagcgtcgtctcacgaccggtgctcgatttagtgtgagtagtttgggtttggggatgagacaaaactgacaagtccccaaggcaggaagatgttgccatcacaactcagtttgggtttctgctgctcgtgggttccacgcctccgaggggtagtaaattgtgctgactcacgtctccagtactttcagtctgtcgaactaccgaaaggaagaaacgtccaaccactaccaccgtcggccgggaccaggtacgagacggtcggttaggtaagtacgtacttaccgagttaccggaaccgacgacgaagaacgaccgtaaggtctacgtacctaaccgaaacgtcctacctacaactacgaagttactcgtacccttaccgacgttccgttcgtaccggtaccgggtcccgtacggtaggtcgtagggcgtacggtaggtacgtaacgtcgtaacggtacctacgttacttcccacctacaacctatacgaatacgggtaccgagggaactacgagaagtatcggactaacgtactaaactttactaacggtntacctagtacgtaaatacgttaaccttaacttaccaagtacgtagtaacccgttactacccggtacggaaccgaacgggtaacncggtaaacgtacggtaaaatacgttaaacgtaggtcgtcgtacgtacgaccttactatttcggttctcttacccg

SEQ ID NO: 171225 - DNA, 594 bp, Homo sapiens
  misc_feature: GYAE6OF01E1I1H.27.78.H01.1.454.CMB.1.raw
  modified_base (463)..(463): a, c, t, g, unknown or other
  misc_feature (463)..(463): n is a, c, g, or t
tcagagcgtcgtctcacgaccggtgctcgatttagtgtgagtagtttgggtttggggatcttaaaagaggttctttctctgggatgtgcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaaccatccaccgtgccgggccagtcagagcgttggtagtagcttacactggtaccagcagaagccaggtcagtctccaaagcctcctcatcaagtatgccttcccagttccctttctccgtacggggtccccctggtacggttcaggttcggctaggtggacttcgtggggaccactactttccgacccctcacctacgtcaaatacgcctaggaacgcgtagaagtntacgctacggactaacttattaccttagtaccgtatctaacgtagttaccttacctttaaccctactaagttcgtaatctaccgttaccggaccgaagggaccacgtacgtaggaagtaagttaaaaccgg

SEQ ID NO: 171226 - DNA, 581 bp, Homo sapiens
  misc_feature: GYAE6OF01EKHWW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaaactcattgggtttctgctgctctgggttccagcctccaggggtgaaattgtgctgactcagtctccagacttttcagtctgtgactccaaaggagaaagtcaccatcacctgccgggccagtcagagcggttggtagtagcttacactggtaccagcagaagccaggtcagtctccaaagctcctcatcaagtatgcttcccacgtccttctcgacggggtcccctcgacggttcagtggcagtggatcgtgggacactactttccaccctcaccatacaatagcctggaagctagaagatgctgtactaacttattactgttacatcagtacgttaccttaactttacctacaacggttgtacctctacccgttccggaaccgaaacgggacctaccggacgtagggaaacgtaacgttaaaacggaacgttggtacgggtactcggtacccaccgtattccgtttgttccttaccg

SEQ ID NO: 171227 - DNA, 606 bp, Homo sapiens
  misc_feature: GYAE6OF01ECAHQ.27.78.H01.1.454.CMB.1.raw
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtccaaccatcaccgtgccggccagtcagagcgttggtagtagcttacactggtaccagcaagaacgccgaggtcagtcctaccaaagcctacctacatacaagtactcgtccttcccgagttcccttcgtccgacggggttcccctcggtacggttcaggttcgcgtaggtggactcgtagggtaccacgttactttaccacccctacaaccctatacaatacgctaggaactcgtagaagntcgctacgtactaactttactacgtactacactacaagtacgtaacctttacttacctacgtaagtctactctacccgttaccggacgaaacggtacctacgaagttacggaagtaacgttaaaaccgg

SEQ ID NO: 171228 - DNA, 693 bp, Homo sapiens
  misc_feature: GYAE6OF01BMMCR.27.78.H01.1.454.CMB.1.raw
  modified_base (205)..(205): a, c, t, g, unknown or other
  misc_feature (205)..(205): n is a, c, g, or t
tcagagcgtcgtctcacgaccggtgctcgatttagtgtgagtagtttgggtttggggatgagacaaaactgacaagtcaaggcaggaagatgttgccatcacaactcattgggtttctgctgctctgggttccagcctccgaggggtgaaattgtgctgactcagtcctccagtactttcagttctgtgacctaccgaaaggaanaagtcaccatccacctgccgggccagtcagagtcgttagggtagtacgctttacacgtggtaaccagacgagaacgccgaggtcacgtctacaacgcctacctcatacaagtacttcgtccttcctacgttcccttcgtccgtaccgggttcccctacggtacggttcgagggtcggacgtaggtcggtacgtcgtaggaactaccttacgttccctaccctccactacgtacaagtacgtcgtaggaatcgtaagtaaggtactcggacgttcgaaacttaaccgttttaagtacgttcggtactacggttaaccaaggttaacctttaacctttacccgtttaaccgtactaacggtttcaacccgttcctaaccggttacggaaccccgaaacgggtcaaccgtacgtaacggtaaggtaaaccgttaacgaacggttcggtaccggtactaccgtactaacgttatcctttacggtcttaaccc

SEQ ID NO: 171229 - DNA, 755 bp, Homo sapiens
  misc_feature: GYAE6OF01BGNQZ.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccacctgccgggcagtcagagtcgttggtagtagcttacactggtaccagcagaacgccaggtcagtctaccaaagctcctcatcaagtatgcttcccacgttccttcctcgtacggggtcccccgtcgtacggttcaggtggctaggtggacttcgtagggactacgtactttccaccccttcaaccctacttacaaaacttcggacccgttagggaaacggtcttacggaaagtaacgttggacccgttacggtaacccttaaaaccttttacgtttaaccgttacgttacctaactttacgaacggttaacgtttaacctttaaacccttttaaccctttaactaaagggttaccgtaactttaccccgttaacccggtttccgggtaaccccggaaacggggtaaccctaaaacccgggtaaccggttaaggggtaaacgttaaacggtttaaaaaacccggtaaacggtttccgggttacgggtaccgttaccgggtaaccctaaacccgttacgtttaccgttaacggttttcccc

SEQ ID NO: 171230 - DNA, 628 bp, Homo sapiens
  misc_feature: GYAE6OF01DBTZC.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcaggggtnaattgtgctgactcagtctcagactttcagtctgtgactaccaaaggagaaagtcaccatcactgccgggcagtcagagcgttggtagtagcttacacgtggtaaccagacaaggaaagccaagggtacacgtacctaccgaaaagctccctacaatacgaaagtactcgtctacccacgttccttctacgtacgggtcccctcggtaaggttcaggtggcacggtgaactcgtagggtacacgtactttaccaccctacaaccatacaaatacgaccgtagggaacacgtaggaaagtactggactagacctaacttatttactgtactaattacaacgtacgttacttaaccttttaaccctagtaaagttcgtaacttcctaaccggttccggaacctaaacgggtacaaccgacgttagggaacgtaagttaaacgaacgtaggtcggactacggacaccgtaacttcgtgttacc

SEQ ID NO: 171231 - DNA, 602 bp, Homo sapiens
  misc_feature: GYAE6OF01A6T95.27.78.H01.1.454.CMB.1.raw
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtcgactaccaaaaggagaaagtccaccatccacctggccggccagtcagagcgttggtagtagcttacactggtaccagcagaagccaggtcagtctaccaaagcctcctcatcaagtntcgccttcccagttccttcncgaccggggttcccctaggtacggttcacggtggccgtaggtggactcgtagggacctacgtacctttaccacccctaccaccctactactaactacggacccgtagggaacgcgtagaagtatcgtactagtacctaactttactacgttatacctatacgacgtacttaaccttaccttacctactagtctataccgtccgtaccggacgaacgggacctacggacgtaggagtaagtaaaccgg

SEQ ID NO: 171232 - DNA, 621 bp, Homo sapiens
  misc_feature: GYAE6OF01A9I2I.27.78.H01.1.454.CMB.1.raw
  modified_base (449)..(449): a, c, t, g, unknown or other
  misc_feature (449)..(449): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatcacctcgccgggccagtcagagtcgttggtagtagcttacacgtggtaccagcagaagccaggtcagtctccaaagcctcctcatcaagtatgccttcccagttccttctcgacggggttccccctcggtaggttcaggtcggcaggtggatcgtgggactacgtactttccaccctcacctactcaagtacgcctaggaacgtctaggaagatcgcgtcgtactaacttattacngtcatacaagtacgtaacttacctttaccagtaagtagtacttaccgtaccgttaccggaccgtaaagggacccaacggtaacgttacgggaaacgttaaacgttaaaaccggtacgttacgggttacggtacgtaccggaccctaacccgttattcccgtttcggttaccc

SEQ ID NO: 171233 - DNA, 593 bp, Homo sapiens
  misc_feature: GYAE6OF01D3QYN.27.78.H01.1.454.CMB.1.raw
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtacttttcagttctgtcgactaccgaaaggagaaagtcaccatccacctcgccgggccagtcagagtcgttggtagtagtcttacacgtggtaccagcaagaacgccaggtcacgtctaccgaaagcctcctctatactaagtatcgtccttaccctacgtccctttcgtcgtaccgggtccccttcggacggttcgaggtcggcgtaggtggtacgtcggtacggacctactaacgtttccaccctacacctatacaagtacgccgtaggaacgtacgtagaagtacgtgtctacgtaactaactttattactntcatcaagtactacttacttactctaacgtgtactcgtacctacgaccgaagacacgacgtagaagtaacgtaagacgtggtcgcgacgctactattctgtctaccg

SEQ ID NO: 171234 - DNA, 740 bp, Homo sapiens
  misc_feature: GYAE6OF01CAI19.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtcctccagtactttcagtctgtgactacgaaaggagaacgtcaccatccacctgccgggccagtcgagagtcgttaggtacgtataccgttaacacgtcggtaaccagacaagaacgaccgaggtcacgtacctaaccgaaacgcctcctacactacgaagtactcgtccttacccgacgttcccttcgccggtaccgggttccccgtagggttacggttcgacggtcggacgtaaggtcggtacgttcggtacggtaactaccttaccgtttaccccaaccccgttacctaacctaacttaaccaaaccgttaccgtaccgtaacggaacgtacgtaagaagtcgtcggacgttacgtaaacttaactttacttacgttacgtactaacgtacgtaacgttaaccttaacctttaaccgttaccctaagtaagttacgtacgttaccctaccggttaaccggaccggtaaacgggaccgtaccgggtaacgtaagggtaaacgttaaacgttaacgtacggtggttaccgtaccgtacggtacccttacgtacttcctacgtttcccgttaaccc

SEQ ID NO: 171235 - DNA, 787 bp, Homo sapiens
  misc_feature: GYAE6OF01AQQNG.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcagttggtttctgctgctctggtccagcctcgagggtagaattgtgctgactcgagtcctccagtacttcgagtctgtacgaacctaccgaaaaggtacgaaacgtccaccactcccgaccgtcggcccggaccagtcaggtagttggttaggtacgtacgtccttacgacgtacgtaccgacgacgaacggaccgcgaggtaccgtacgttacccgtaacgtaacgtccctacctacgaactaccgtaagtactccgtcccttaccgtacgttcccgttacgtcccggtacccgggttcccgtacggtacggtacgtacggtcggtacgtacggtacgtacgttccggtaacggtaacctacgttaccttaccccgaccctaccaacctaactacgtaacgtaccggtacgtacggtaacgaccgtaggtacgtacgtctaccgtaacgttaccttaaacgtttcgttacgtcgtacgtaaccctagtaaccgttactttaaccgttaccgttaacgtacgtaacgttccgtaacgttccccgttaaccggaccgtaacggaaccggtaccttaaacgggtaacgttaacggtaaaccgttaaagttaacggttcccgtagggttacccgtacggtaaccgtacccgttaccgttaacgttcccgtttacgttaccccg

SEQ ID NO: 171236 - DNA, 645 bp, Homo sapiens
  misc_feature: GYAE6OF01BUBHQ.27.78.H01.1.454.CMB.1.raw
  modified_base (179)..(179): a, c, t, g, unknown or other
  misc_feature (179)..(179): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtnaaattgtgctgactcagtcctcagtactttcagtctgtcactacgaaagganaaacgtcacatccaccgtggccggcagtcagngtcggttgtagtagtcttacacgtacggtaccagcgtaacgaagccgtaggtcacggttcaccgaaagtccttcgtacattacaagttactacgtcccttacctacgttcctccgtacggacgggtcccctggtacggttacagggtcgtacgtacggtgtactcggtacgggtaacctacgtacctttcctaccccgtactaacccacttaaccgaacgtacgtcccgtaaggacgtccgtaagaacgtacgtgacctcgtaacttaacctttagttactcctacactacgataaccgttaccttaccttacaactagtactacgtaccctacggttaccgacggaaaccggtacacggtagtaacgtagtaactaaacgg

SEQ ID NO: 171237 - DNA, 815 bp, Homo sapiens
  misc_feature: GYAE6OF01EHXRE.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggggtnaattgtgctgactcagtctccagtactttcagtctgtgactaccgaaaggagaaagtccaccatccaccgtcggcccgggcacgtcaggagtcggttaggtacgtagtccttacacgtacggtaccagcgaagaacgccgtaggtcacgtcctaccaaagccttcctacacgtactaagttactcgtccttacccgtacgttccctttcgtccggtaccggggttcccccttacgggtaacgggtttaacggtcggtacgtagggttacgtagttcggtacgggtaacctaccgttacgtttaccccacccctaccgtaaccctaacttaccgaaacgttaccggtacccggttaaggggaacgtaccgttaagggaaacggtacgttacgggtactaacgggttaacctttaaacttttacgtttaccttaggttacctaacgtttacgtaaacggtttaacgtttaaccttttaacccgttttaacctaccgggttaaagttaccggttaacctttaccccggtaaccccgtttaaccggggaaccggtaaacccgggtaaccgtaacgggtaaccgttaagggtaaacgtaaccgttaaacggtacggtacgggtgaccgttcgaaccgtacctttacgtacctttacgtcccttcgttacccg

SEQ ID NO: 171238 - DNA, 718 bp, Homo sapiens
  misc_feature: GYAE6OF01CXQUS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccacgcctccgaggggtagtaaattgtgctgactcagtctcagtactttcagtctgtagacctacgaaaggagaaagtccaaccactccaccgtcggcccggaccagtcgagaggtcggttaggtagtacgtcttacacgtacggtacagacgaagacgcgtagtcacgtactaccaacgtcctcctactatactaagtatccgtcctaccctacgttccctttcgtccggtacccggggttcccgtacggtacggttcgacggttgggacgtaggttaggtacgttccgacgggtactaaccgtacctttacccaacccctacaaccctaactacgtaaacgtacgacccgtaggaacggtactaggtaacgtagtcgtacgtaacgtaactacgtttacttacgttatacctactaacgtaaggtaacctttaacttacccgtttaacgtactacggttactacttacccgtaccgttaaccgggaccggaaaccggaccgtaaccggtagtacggtaacgtaaacgtaaccggtaggtaccggtcgtacgacgtacccgtactagttaccttgttaccttcccg

SEQ ID NO: 171239 - DNA, 715 bp, Homo sapiens
  misc_feature: GYAE6OF01CFP8H.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaacgtcaccatcacctgccgggcagtcagagtcgtggtagtagcttacactggtaccagcagagcaggtcacgtctaccaaagcctcctcatcaagtactcgccttcccacgttccttctccgtacggggtcccctcggtaaggttcaggtcggctaggtggacttcgcggtacaactcttccacccgtcaaccatacctaataccgaccgtaggtaacgccgtagtaaggactggaccttacgaacttaaaccgtttactttaacgtcgttactaacttaccgaacggttaaccgtttaacctttaaccttttaacccgtaaccgtaaacggttaccgtaaccttacccggttaaacccgttaccccggggaccgtaaacggggtaacccttaacgggaacccgttaacgggtaaacggttaaaacggttaaaccggtaacgttacggggtaccggttaacccgacgggtaaccctaacccggttattaccccgtttcggttaccccgttttaccg

SEQ ID NO: 171240 - DNA, 503 bp, Homo sapiens
  misc_feature: GYAE6OF01BMPY2.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (324)..(324): a, c, t, g, unknown or other
  misc_feature (324)..(324): n is a, c, g, or t
  modified_base (381)..(381): a, c, t, g, unknown or other
  misc_feature (381)..(381): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctgccgggccagtcagagcgttggatagctttacacttgggtaccagcagaagccaggtcagtctccaaagctcctcatcaagtatgcttcccagtcctctcagggtcccctgnggttcagtggcagtggatctgggacactatttcaccctcacatcaatagcctggaanctgaagactgctgacaacttattactgtcattcagtagtacttacttacctacagtgactcaccttcggaccaagggacacgactggagattaaacgactgngcncgacaccatctgtcttc

SEQ ID NO: 171241 - DNA, 804 bp, Homo sapiens
  misc_feature: GYAE6OF01BIZGZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaattgtgctgactcagtctccagtactttcagtctgtgactccaaaggagaacgtcaccatcacctggccggccagtcagagtcgttggtatagcttacgactggtaccagacaagaagccaggtcacgtctaccaaagtcctcctacatacgaagtactcgtccttacccgtacgttccctttcgtaccgtaccggggttcccccgttacgggtacggtttaccgacggttcgggaccgttaggtacggtaagttccgggtaggggtaacctaaccgttaccgttttacccgtaacccccttacgtaaaccccttacgttaaccgtaaagttacccgggaacccttaacggggtaaccgtaccggttaacggtaaacgggttaaacttcgggtaacgtttaccggaaaccgtttaactttttaacgttaaccgtttacggtactaaacgtaccgtaaacgggtaacttttaaccctttaaccgtttaacccgtaacgtaacgttacggtaaccccttacggttaacccgtttacccgggaaccggaaacgggtactaaccggtaccggtaaggtaaacgtaacgttaaacgggaaaccgttggtaaccgggtaccttacggaacccttaacgtacttacgtaccgtttccgtaaccg

SEQ ID NO: 171242 - DNA, 669 bp, Homo sapiens
  misc_feature: GYAE6OF01DDEFX.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgagggtgaaattgtgctgactcagtctccagtactttcagtctgtgactaccgaaaggaagaagtcaaccatccacctcgcccgggccagtcagagtcgttggtagtagacttacacgtggtaccagacagaacgccgtaggtcacgtcctaccgaaacgcctcctacactacgtaagtacgtcgtaccttccccgtacgttcccgttccgtccggtaccgggttccccctcggtacggttcaggtcggacgtaggtgtacgtccggtacgggtaacctacgttactttcccaccctaccaacctactaccgtaacgtcgtaccgtaagggaccgtcgtaagaacgtagtcgtacgtagtaccttaacgtttattacgtcgtactatacaacgttaacgttactacctttacacgtaagtcgtactacccgtaccgtcgaaccggtaacgaccgaacgtacgtagggtaaacgttaacgttaaacgtcggtcgtagtacctacgaccctacgtacttcgtacttcccg

SEQ ID NO: 171243 - DNA, 719 bp, Homo sapiens
  misc_feature: GYAE6OF01APQJ6.27.78.H01.1.454.CMB.1.raw
  modified_base (187)..(187): a, c, t, g, unknown or other
  misc_feature (187)..(187): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
tcagagcgtcgtctcacgaccggtgctcgatttagtgtgagtagtttgggtttggggtagtgagcaaactagacaagtcaaggcaggaagatgttgccatcacaactcattgggtttcttgctgctcttgggttccagcctccagggtggaaattgtgctgactcagtctccagtactttcagtctntgactaccaaaggaggaaatcaccatccacctgccgggccagtcagtagcgttgagtancttacagtcggtaccgacncgagaagccagtcgatctccaaagctcctcataccaagtatacgtccgttccctaggttccctttctcgtacggggttacccccgtcgtacggttccgtagtcggccgtaggtgtacgtcgtcggggtacctaaccgtatttcctaaccctcctaaacccacttacgtaactaacggtcctaggtacgacgttacgaagtagtcgtcgtagcctaaactttactttaccttcggttactaacgttactaacggttaacgtaacccgttttaacctttacccctttaaccgtaaggtacgtactaccgttaccgtttaccgggaccgaaacgggtaccgaaacgacccgttaaagggaccgttaaacgtttaaacccgggtactaacgggttaaccgggtctaaccggtacccggtaaacccttgttaaccgttcccggtttacttttaaccccg

SEQ ID NO: 171244 - DNA, 686 bp, Homo sapiens
  misc_feature: GYAE6OF01B4QTR.27.78.H01.1.454.CMB.1.raw
tcagagcgtcgtctcacgaccggtgctcgatttagtgtgagtagtttgggtttgggatcttaaaagaggttctttctctgggatgtggcatgagcaaaactgacaagtcaaggcaggaagatgttgccagtcacaactcattggttctgctgctcgtgggttccagcctccgaggggtgaaattgtgctagactcacgtctccaggactttcgagtctgtgactcaaaggagaaagtcaccatccaccgtcgccggccagtcagagcgttggtagtagtcttaacgacgtcggtaaccagacgagaaagccgaggtcagtaccaccaaagcctacctcgaatacaaagtagtcgcttcccacgttcctactcgacgggtcccctacggtacgtcaaggttcgctaggtagacgtcgacgggtacaacgtactttcccgaccccttacgaccctaactactaaacgtaccggaccgtacgggaaacgtcgttaacgaacgtacgtcgtacctacgtacctaaccttacttaccgtacgtactaacgtcctaacgtaccgttaaccttaccgtttaacctacgtaaacggtacgtaccttacccgtacccggtttacccgggaaccgaaacccggggaacttaacccggaacgggttaaccggaacggttaaaccgttaaaaaccggg

SEQ ID NO: 171245 - DNA, 747 bp, Homo sapiens
  misc_feature: GYAE6OF01BYJAO.27.78.H01.1.454.CMB.1.raw
  modified_base (148)..(148): a, c, t, g, unknown or other
  misc_feature (148)..(148): n is a, c, g, or t
  modified_base (155)..(155): a, c, t, g, unknown or other
  misc_feature (155)..(155): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtnaaattgngctgactcagtcctccagtactttcagttctgtcgacctaccgaaaggagaaacgtccaccactccaccgtcggcccgggaccagtcgagacgtcggttaggtagtacgtcgtttaacacgttacggtaccagacgaagaacgccgaggtcgagtacctaccaaacgcctacctacaatacgtaagttacgttccgtacctttaccccgtagttccccgtttacgtaccggtaccggggttccccctagggtaacggttccgagggttcggaccgtaggtcggtacgtccggtacggtaactacctaccgtttaccaccccgtacaaccgtataccgaagtacgtaccgtaggataccgtagaagtacgttacggactaacgtaacctttaacgtttaacttcgtagttacctacgttacgaacgttacgtttaacctttaccgtttaactacgtaaggttactacgttacccgtacccgttaggaacccgtacggaccgtaacgtaccggaaggtaaccgttaaacgtaaacgtacggttacgtacggtacctacggtacctaaccttattaccgttcgtaccctttaccg

SEQ ID NO: 171246 - DNA, 628 bp, Homo sapiens
  misc_feature: GYAE6OF01BD0UN.27.78.H01.1.454.CMB.1.raw
  modified_base (352)..(352): a, c, t, g, unknown or other
  misc_feature (352)..(352): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagttctgtgactaccgaaaggagaaacgtcaccatccaccgtcggccgggccagtcgagagtcggttaggtagtagtcttacacgtggtaccagcaggaacgccgaggtccacgtctaccaaacgtcctactcatcaagtntcgtccttcctacgttcccttcgtcggtaccgggtcccctcggtacggttcgagggtcggcgtaggtggactcgtacgggacacgttactttaccacccctcacctactacaatacggccgtaggaacgccgtagaacgtgtacgctacgtaccttaacgtttacttacgttgtactacgtacgaagtacttacctttactttaccgtagtaacgtctaatccgtaaccgttcgaaccgaacggtacacggtataaggaacgtaacgttaaaccgg

SEQ ID NO: 171247 - DNA, 687 bp, Homo sapiens
  misc_feature: GYAE6OF01B7CI1.27.78.H01.1.454.CMB.1.raw
  modified_base (151)..(151): a, c, t, g, unknown or other
  misc_feature (151)..(151): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtnaaattgtgctgactcagtctccagtactttcagtctgtgactaccgaaaggagaagtcaccatcaccgtggccggcagtcagagtcgttggtagtagtcttacacgtcggtaccagacgaagaacgccgaggtcacgtcctaccaaacgtcctcctacatactaagtatcgtccttcccgtacgttccttccgtccggtacccggggttccccttacggtacgggtttccgaggtcgggacgtaggtgggtacgttcggtagggacctaacgttactttaccccaccctacaccctaatactaacgtacgtaccgtaggaacgtcgtaggaagtcgtacgtacgtacgtaaccttaactttacttaccgttgtactagtacgtagtaacctttactttaccttaactacgtaagtcgtacttaccgtacccggttacgaccggtaacggtacgaccggtaacgtacgggtaaagttaacgtaaacggtcgttacggtcgtacggtacgtaccacgttcgttccggttctttacccg

SEQ ID NO: 171248 - DNA, 840 bp, Homo sapiens
  misc_feature: GYAE6OF01BOVWW.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaaggcaggaagattgttgccatcaacaactcagttgggtttctgctgctcgttcgggttccagtcctcgaggggtagtaaattggtgctgactcagtcctactagtactttcgagttctgtacgaacctaaccgaaaaggaagtaaacgtccaacctactaccgaccggtcggcccgggtacctaacggacgtaacggacggttcggttagggtaagtacgtaccgttacacgttacggaacctagaccgtaagaacgaccggtaggtacacgttacctaaccgaaacgtccttaccgtataacttaaccgtaagttaactccggttaccccttaaccgtccgtttcccgttaccggttacccggggttaccccgggttaccccgttaacgggttaccgggttaccggacgggttacgggtaccgttaggggttacgtaacggttccggtaacgggtaacctaccctttaccgttaccctaacccgtaccgtaacctaacgtaactaacgtaacgtcgtaacggtaactacggtaggaaactcgtacgtaccgtaacgttaaccttaaacgttacgtacgttataaccgtatacgtaacgttaaccttaacccgtttaaccttaccggtaaacttggtaaccgttacctaaccgttacccggtacgggaaaccgtacgggtaaaccgtaccgtaacggtaaaggtaacccgttaaaggttaaaaccgg

SEQ ID NO: 171249 - DNA, 768 bp, Homo sapiens
  misc_feature: GYAE6OF01AO13O.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagttctgtcgactaccgaaaggaagaaagtccaccaactccaccgtcggcccgggaccagtaccgaggagtccggtttggttacgtacggtaccttacgacgttacgggtacacgacgaaggaacgtacccgacggtaccacggtacctaccgaaacgtccttacctaacgtactaacgaacgttaacgtccgtacctttacccgtacgtttcccttaccgtaccggtacccggggttaccccttacgggtacggtttaccgagggtcggacgtacggtagtacgtcggtacgggtacctacgttaccttaccgacccctactaacctacgtactaactaccgaccgttaggacgtacgtaggtaagtcgttaccgagtacgtaactttaaccttacgttaccgtacgtactacgtagtaaccgtttagttaaccctttaacgtttactaacgttacggtacgtaccttaccgaccgttaccggaacggtaaccggtaaccgtaacggtaccgtaaggaacgttaaaccgtaacggtacgttcggacgtacgtaccgactaccgttacctcgttaccgtcgtttaacccg

SEQ ID NO: 171250 - DNA, 632 bp, Homo sapiens
  misc_feature: GYAE6OF01CIO12.27.78.H01.1.454.CMB.1.raw
  modified_base (305)..(305): a, c, t, g, unknown or other
  misc_feature (305)..(305): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatcacctcggccgggccagtcagagtcgttggtagtagtcttacacgtaggaccagacagaacgccaggtcagtctaccaagctcctcatacaagtntcgtccttcccacgtccttctcgtacgggtcccctggtacgttcgaggtggcgtagtgagtcgtggactctacttccaccctcaccgtatacaatacgacgtacggagctaggaatacgtgacctagtaacctaacttttacgttacttacgtacctaatcttaaacggtactttaacccgtttaactttcccgttaactaacgggttctaccgtaccttaccggttaccggacccggtaacgggaacctacggacgtacggaaacgtaacgttaaaccgtacgttcggtcgtacgtcgacctaccgttatccttcgtacttacccg

SEQ ID NO: 171251 - DNA, 727 bp, Homo sapiens
  misc_feature: GYAE6OF01DD7DC.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaaagtcaaaggcaggaagatgttgccatcacaactcattgggtttctgctgctctgggttccagcctccaggggtgaaattgtgctgactcagtctccagactttcagtctgtgactaccaaaggaagaaaagtcaccatccacctggccgggccagtcagagtcggttaggtagtagtcttaacacgtacggtaccaagccaagaaagtccgaagggtcacggtcctaaccaaacgcctcctacaatacaacgtaatcgcccttacccacgttaccccttcgtaccgtacgggggtccccctacggtaggttaccaaggtcgggacgaggtacggtattaccggtcggggtaaacaactaccttttacccgaccccttaccaactactaaccgtaaagtaccgtcccgttaagggaaacgtccgtaggaaacgtaagtacggtcgtacggaaccttaaactttaaactttaacgtcttaaccgaagttaccgaagttaacgttaacctttaaacctttaaccgttactaaacggttaataaccgttacgtaaccccgtttaaccggaccgaaaacgggaccgaaacgtaccgtaaagggaacgtaaacgttaaaaaccgg

SEQ ID NO: 171252 - DNA, 676 bp, Homo sapiens
  misc_feature: GYAE6OF01EIW9K.27.78.H01.1.454.CMB.1.raw
tcagagcgtcgtctcacgaccggtgctcgatttagtgtgagtagtttgggtttggggggcatgggcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaacgtcaccatccaccgtcggcccgggccagtcgagacggtcggttaggtagtagcttacgacgtcggtaccagcaagaacgccaggtcacgtctaccaacgcctacctcaatacaagttactcggtaccttacccgtacgttcccttccgtaccggtaccggggttccccctacgggtacggttcgaggtcggcgtacggtaggtacgtcgtacgggaacctacgtactttcccaccctacgaacctactacctaagtacgccgtaggaacgtcgtaagaacgtagtacgacgtacgtaacttaactttacttacgttagtacctatacgtaagttaactttaaccttacgtttaactacgtaacgttagtaccttaccgtaccgttaccggaaccgtacgggacacggacggtagaacgtaacgttaacgtagtcggtacgtcgacgtacactagttcttcgttcttaccg

SEQ ID NO: 171253 - DNA, 723 bp, Homo sapiens
  misc_feature: GYAE6OF01CSTDM.27.78.H01.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaattgtgctgactcagtctccagtactttcagtctgtgactcgaaagganaaagtcaccatccaccgtcgccgggcagtcaaggngtcggttggagtancttacacgtggtaccagcagaagcctaggtcagtctacgaanctctcactacgaatctcgtccttacccagttccctttcgtccgtaacggggttcccctaggtacggttacgacggtcggtcgtaggtaggtacgtcggtagggaacctacttacctttaccaacccttacaacctaacgtactaaacgtacgtacccgtagggaacgtaccgtaaggtaacgtacgtcgtaacgttacggtaaccttaaacggttttaacttacgttacgtacgtaacttacctaaggttaactttaaccctttaaccgttttaaccctaacgttaaacggtactaaccgtttacccgaaccggtttaccgggaaccgaacgggttaacacgggtaaacgtacgggtaaaacgtaaacgttaaaccgacggttacgacgggtacctacggacccttaacgtagtttcctcggttctttaaccc

SEQ ID NO: 171254 - DNA, 728 bp, Homo sapiens
  misc_feature: GYAE6OF01CWJHL.27.78.H01.1.454.CMB.1.raw
  modified_base (249)..(249): a, c, t, g, unknown or other
  misc_feature (249)..(249): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaattgtgctgactcagtctccagtactttcagtctgtgactaccaaaggagaaagtcaccatccacctggccggacagtcagagtcgttggtagtagcttancgtggtaccagcagacgcaggtacacgtctaccaagtcctcctcatactaacgttatccgtccttcccacgttccctttcgtaccgtaccggggttcccctacggtacggttcgtaggtcggaccgtaggtcggtacgttcggtacggtactacgtacttccctaacccctacctaccgtaactacctaaagtaccgtaccgtaacgggaactcgtaagggtaacgacgttacgcgttaacgtaaaccttaacgttttaccgttactacggttacctaagttaccgtaaaggttacccgtttaacctttaacctttaacccgtaacgttaacggttactaccgttacccgttaccgttacccgggaccggtaaacgggacctaaccggtacggttaacggtaacggtaaaacttaaccgtacgggtcgttacggtactaccgtacctaaccttacgtttcgttacgttcccttaacccg

SEQ ID NO: 171255 - DNA, 892 bp, Homo sapiens
  misc_feature: GYAE6OF01DPB59.27.78.H01.1.454.CMB.1.raw
tcagagcgtcgtctcacgaccggtgctcgatttagtgtgagtagtttgggtttgggatgagcgaaaactgacaagtcaaggcaggaagatgttgccatcacaactcagttcgggtttctgctgctcgtggttccagtcctccgagggtagtaaacttggtcgctgactcagtcctccagtactttcagtctgtacgacctacgaaaggagaaaacgtccaaccatccgaccgtcggcccgggccagtccgagacgtcgttaggtagtacgtacgttacgacgtacggaacctagcgaagaacgcgaggtctagtcctaccaaacgctacctacgactacctaacgttactccggtaccttcccgtaacgttccctttcgtaccgtacccggggttaccccctagggtaccgttacgaaggtcggaccgtaggtacggtaacgttccggtaggggaacctaacgttaacgttttccccgaacccctaccgtaacctaacgtaacgtaaacgttacgtaccggtaacggtaaccgtcgtaacggaacgtacgttcggaaccttacggtaaacccttaacgttttaacttaccggtttaacgtaccgtaacgtttaaccgtaaacggtttaaccgtttaaccgttttaaacccgttttaacccttaacggtaaacggtttaccgtaaccctttacccggttaaccccgtttaacccggggtaaccgggtaaaccgggtaaaccgtaaccgggtaaaccgttaacgggtaaaaccggttaaaaccggttaaaaacccgggttacggttaaccggggttaaccgggttacccgtaacggtaacccccgttaacgttaaccgtttccccggttacggttttcccgtttaaacccccgg

SEQ ID NO: 171256 - DNA, 633 bp, Homo sapiens
  misc_feature: GYAE6OF01EOY24.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtcaccatccacctgccgggccagtcagagtcgttggtagtagtcttacactcggtaccagacagaacgcgacggtcagtcctaccaaacgctcctacactcaagtatcgtccttccctacgtcccttcgtccgtacggggtcccctcggtaggttcgagtggcaggtggatcgtaggactacgtacttccaccctcacctatacaatacgcgtaggaagtcgtagaagtatgactgtactaactttactttacgtcgtactactactaacggtaacttacctttaacgtttacctacgtagttaccgtaacttaccttaacccggtaccgaaccggtaacggactaccggtacgtaaggtaacgtaaacgttaaaacggacttgggacgtaccgtacgaccctaacactttacttccgttcctttacccg

SEQ ID NO: 171257 - DNA, 815 bp, Homo sapiens
  misc_feature: GYAE6OF01ESW6N.27.78.H01.1.454.CMB.1.raw
  modified_base (201)..(201): a, c, t, g, unknown or other
  misc_feature (201)..(201): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaagganaagtcaccataccacctcggccggccagtacaggagtcggttaggtagtacgtcttacacgtcggtaccagcaagaacgccgaggtcacgtacaccgaacgtcctacctctactacgaagttacgttcgtccttacccgtacgttcccgtttcgttaccggttaccgggggtttccccctttagggttacgggtttaccgagggttaccgggtacggtaacggtttacggaacgttcgggttacgggtaacctaccgttaaccgtttaccctaccccgttaccaacccttactaaacctaacggttaccgtaccgggtaacgggaacgttacgtaacgggaaagttacggtcgtacggttacgtaacctttaacgttttaacttacgtttacgtactaacgttacgttaaaagttaccgttttaacctttaaccgttttacctaaaccgttaacgttacgttaacccttacccggttaaccggtttacccggaaccgggtaaccggaaccgtaaacggtaccggtaagttaaacggtaaacgttttaaaccggacggttacgtcgggtacctaaccgcctaaccgggtactttccggttcgtcccgtttacccg

SEQ ID NO: 171258 - DNA, 657 bp, Homo sapiens
  misc_feature: GYAE6OF01B4BFJ.27.78.H01.1.454.CMB.1.raw
  modified_base (118)..(118): a, c, t, g, unknown or other
  misc_feature (118)..(118): n is a, c, g, or t
  modified_base (150)..(150): a, c, t, g, unknown or other
  misc_feature (150)..(150): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
tcagagcgtcgtctcacgaccggtgctcgatttagtgtgagtagtttgggttgggggcatgagcaaaactgacaagtcaaggcaggaagatgttgccatcacaactcattgggtttcngctgctctgggttccagccctccgaggggtanaaattgcgctgactcagtcctccgagtactttcgagtctggtacaccaccgaaaggagaacttcacctatccgaccncggccgggtaccagcaaggtcgnggtttaggtagtaccgcctttagaccgttggaacccngaccaggaacnccgttaggcaacgttccacaancccttcacaganaagttnctacccttccggaatttccctcgaacgccggggtccctagaggttccaggncgtagngtancggtgacattcggtccactcactatcggaatccgngngaacgngtagaaagcgttccatactaccttacttaatagggtttccaacttacgggacttaaggttacctaacccttttaaccgggtctaccgtaaggttccactttaccccggacgttcccgaaccgtaacgggactttacccgaggaaccgtaagtaaacgtaaaacgttccgtgttaacccgggnaaccnccctaaatttcggggcctttgttacccc

SEQ ID NO: 171259 - DNA, 659 bp, Homo sapiens
  misc_feature: GYAE6OF01ELDCW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtccaccatccacctgccgggccagtcagagtcggttggtagtagcttacacgtggtaccagcaagaacgccaggtcagtcctaccaaagcctcctacatacaagtactcgtccttccctacgttcccttctccggtaccgggtcccctggtacggttcgaggtcggcgtagtggatcgtacggacactctttaccaccctacacctatacaatcgaccgtaggaacgtcgtagaagtagtcgactgtaactaactttacgttactgtctactactaacgtacttaaccttaccgtttactaacgtacgttacgtacttaccgtacccgttaccggtaccggaacgggtaccgtaaccgtacggtaacgggtaacgttaaaaccgtttaaaccggtaaggttcgggtacggtaccgtacgtaccctaacccgtagttaccgttcgttcccttacccg

SEQ ID NO: 171260 - DNA, 949 bp, Homo sapiens
  misc_feature: GYAE6OF01CUW8K.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgagggtnaattgtgctgactcagtctcagtactttcagtctgtgactacgaaggacgtaagtcacatcaccgtgccggcagtcgaagtgtcggttggtagtcgtacttacgacgtcggtaccagacgaaggaacgccgaggtaccacggtcctaaccgaacgtccttacctacgtaactaccgtaaggttaactcccggtaccctttaccccgaacggttttcccgtttaccggtacccggttaacccgggggtttcccccgtaggttaccgggttaccggacgggttcgggtacggtaacggttaggggtacgttacccgggtacggggtaaccctaacgtttacccgttacccggaacccctttaccggaaacccgtacgttaaccaaacggttaccggtaccgttaacgggaactaccggtaagtaacggtaactcggtaccttaacgggtaacctttaaacggttttaacgtttaccttaggttaaccgttaaccgtaacgtttaaacgttaaccgtttaacccgtttttaaccgtttaacccgtaacggttaaaccggtttaccgaaccccgtttaaccccgggttaaccccgtttaaacccgggggaaccgtaaacccgggggtttaaaccgttaaacccgggtacgggttttaaaacggggaaaacccgttttaaaaccggtttaaaacggggtaccgttttacccggggttaaccggggttacccttaaacccggttaccccgttaaaccccggtttagtttacccccggttttggttaaccccctttttaaacccccggg

SEQ ID NO: 171261 - DNA, 527 bp, Homo sapiens
  misc_feature: GYAE6OF01B54RR.27.78.H01.1.454.CMB.1.raw
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (373)..(374): a, c, t, g, unknown or other
  misc_feature (373)..(374): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
  modified_base (474)..(474): a, c, t, g, unknown or other
  misc_feature (474)..(474): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctcgccgggccagtcagagcgttggtagtagcttacacgtggtaccagacagaacgccaggtcagtcctaccaaagcctcctcatacaagtatcgcttcccattcctctcgcggtccctgngtcngtgnngtgntcgnggacactacttccacctcaccatcaatcgcctagacnctagatatgctcgactaattctacgttgtcatacagtacttacttaccttactanaagtcactccgtaccgtcggaccgaacggaccacgacgtagaagtagtaaacg

SEQ ID NO: 171262 - DNA, 679 bp, Homo sapiens
  misc_feature: GYAE6OF01AR9QQ.27.78.H01.1.454.CMB.1.raw
  modified_base (181)..(181): a, c, t, g, unknown or other
  misc_feature (181)..(181): n is a, c, g, or t
  modified_base (234)..(234): a, c, t, g, unknown or other
  misc_feature (234)..(234): n is a, c, g, or t
  modified_base (520)..(520): a, c, t, g, unknown or other
  misc_feature (520)..(520): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctcgtgggttccagcctccaggggtnaaattgtgctgactcagtctccagtactttcagtctgtagactaccaaagganaaagtccaacctatccaccgtggccgggaccagtcagagtcgttggtagtagtcttacactggtaaccagcaagacgccaggtcacgtcctacaaagtcctacctacagtactaagtactcgtccttacccgtagttcccttacgtacgtacccggggtcccctcggtaagggtttccaggttcggaccgtaggtacggtacttacggacgggtacaccttacttcccaaccctcctaccactactaaagtacgtcccgtaaggtaaaccgctaaggaagtacgtnccgtacgtaccttaactttacttaacgttacgtacctaacttacgtaacgtaacttaaccttactttaaaccgtacgtaagttcgtaactcccttaacccggttacgaaccggtaacgggtactaaccggaggttacggaaacgttaacgttaaaacgg

SEQ ID NO: 171263 - DNA, 685 bp, Homo sapiens
  misc_feature: GYAE6OF01CM4I9.27.78.H01.1.454.CMB.1.raw
  modified_base (177)..(177): a, c, t, g, unknown or other
  misc_feature (177)..(177): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctcgagggtnaattgtgctgactcagtctccagtacttcagtctgtgactacgaaaggagaagtcacatcaccgcgccggcagtcgagagtcgttggtagtacgtactacacgtacggtaccagacgaacggaacgaccgaggtccacgtacctaaccgaacgcctcctactaactactaagtactcgtaccttcccgtacgttccttccgtaccggtaccgggtcccctcggtacggttcgtaggtcggtacgtaggtcggacgtacgtacgggaacttaccgtactttacccgtacccctacgtaaccctaatacctaaaacgtccggtaccgtaggaacgtacgtaggtaacgtagtcgactacgtaaccttaagtttaccttagtcgtactacgtactacgtaactttaccttaaccttaccgtagtaacgtacgtacctaccggtaacccgttaccgggaaccgtaacgggtaaccaacggtacggtaacgtaaaggtaaacgttaaaccggg

SEQ ID NO: 171264 - DNA, 755 bp, Homo sapiens
  misc_feature: GYAE6OF01BEAQZ.27.78.H01.1.454.CMB.1.raw
tcagagcgtcgtctcacgaccggtgctcgatttagtgtgagtagtttgggtttggggggcatgagcaaaactgacaagtaaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagacagaacgccaggtcagtcctaccaaagcctcctcatacaagtatcgtccttcccgacgttccttctccgtacgggtccccctacggtacggttcgagtcgggctaggtacggtagtcgttacgggaactacgtaactttcccaacccctaccaaccctaacttacctaaaactacggtacccgtaagggaaccgtacgtaggaaacgtacgttacgaccgttacggtaccttaaacgtttaactttaccgtacgttacctaactacgaacgttaacgttaaccctttaaccttttaaccgtacgtaacgttacgtaactttacccgttaacccggttaccccgggtaccgtaaaccggggtaccgtaaacccggtaccggtaaggggtaaacgttaaaccggtttaaaaccggtacggttccgggttaacggtacccgttaacgaccccgttaacccttaacgtttccgtttccggtttaccctttaaaccccg

SEQ ID NO: 171265 - DNA, 752 bp, Homo sapiens
  misc_feature: GYAE6OF01BY84G.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccgggccagtcagagtcgttggtagtagcttacacgtggtaccagcagaacgccaggtcagtcctacaaagcctcctacatacaagttactcgccttcccgacgttccctttccgtacggtaccggggttcccccgttacggtacggtttccgaggttcgggacgtaggttcggtaacgttcggtacgggaacctaccgtacttttcccaccccgttacaaccctactacctaaacgttaccggtaccgtacgggaacgtacgtaaggtaaagtacgtacgtaccgttacgtaaccttaaacttttagtttaaccttcggttactacgtacgtaacggttaacgttaaccctttaaccgtttaaccgtaacgttaaacggttacgtaaccttaccgtaacccggtttccgggaacccgtaacgggaaccgtaaccggtacggtaacgggtaaacggttaaaccgttaaaacgggtaacgttcgggtacggtaccgtacggtaccttaacccgtagtttccgttagttcctttaacccg

SEQ ID NO: 171266 - DNA, 572 bp, Homo sapiens
  misc_feature: GYAE6OF01A5QEC.27.78.H01.1.454.CMB.1.raw
  modified_base (314)..(314): a, c, t, g, unknown or other
  misc_feature (314)..(314): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattggtttctgctgctctgggttccagcctccaggggtgaaattgtgctgactcagtctccagactttcagtctgtgactccaaaggagaaagtcaccatcacctgccggcagtcagagcgttgtagtagcttacactggtaccagcagaagccaggtcagtctcaaagctcctnatcaagtatgcttccatccttctcagggtccctgagttcagtgcagtgatctgggactactactttcaccctcaccactacaatagcctaggaagtctagaagtatgccgtgactaactttactacgttgtactattacaagtaacgttaacttacctttacctacgtaaagtcggtaatcccgttaccgtttaccggaacccgtaaacgggaacccgtaacggaccttaacggggaagtaacggtttaaaaacccgg

SEQ ID NO: 171267 - DNA, 777 bp, Homo sapiens
  misc_feature: GYAE6OF01C6ZWD.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcaggtctgtgactccaaaggagaaagtcaaccatcacctgccgggccagtcagagtcgttggtagtagcttacacgtcggaccagcaagaacgccaggtcagtcctacaaagctcctcatcaagtatcgtccttcccacgttccctttcgtccgtaaccgggggttcccccttacggtacggttaccgaggttcgggtaccgtaggttacgggtaacttcggttacgggggaacccttaacgttaaccttttcccgaacccccttccaaaccctacttaaccgtaaaacgtaccggtcccgttaagggtaaacggtcccgttaagggaaacgtagttacggtccgtagtaacccgttaaacttttacgtttacgttccggttactaactaccgtaaaggtaaccgttttaaccctttaacccgttttaaccgtaactaaaggtttacgtaccttacccgtaccccggtttaccgggacccggtaaacggggtaaccctaacgggtaccggttaagggtaaacggtaaaccgttaaaacgggtaacggttaggtaccggtactacggtaccacccgttattccgttcgttcccttaacccg

SEQ ID NO: 171268 - DNA, 668 bp, Homo sapiens
  misc_feature: GYAE6OF01CO2TJ.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagttttgggtttgggggggcatgagcaaaactgacaagtcaaggcaggaagatgttgccatcacaactcattggtttctgctgctctgggttccagcctccaggggtnaaattgtgctgactcagtctccagtactttcagtctgtgactaccgaaaggagaagtcacactcacctcgccgggcagtcaggagtcggttggtacgtagcttacacgtggtaccagacaagacgcgagtcacgtccaccgaaacgcctcctacactacgaattatcgtcctaccctacgttccttaccgtccgtaccggggttcccctacggtacggttcgacggtggactagggtgagtcgtacgggactactacgttccaccctacactactactagtacgtacctaggaacgtcgtagtaacgattcggactacgaccttaacgtttattaccgtctactactacgtacgttaaccttacgtttaaccttaacctacgtaacgttctacgttacccttaccggttaccggaccgaaacgggacccgtaacgacggttaacggaaacggttaacgttaaacggtaccgttggtaccggtacgtaccgacttaaccgactttccgttatttacccg

SEQ ID NO: 171269 - DNA, 830 bp, Homo sapiens
  misc_feature: GYAE6OF01EYTTP.27.78.H01.1.454.CMB.1.raw
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcaacaactctattgggtttctgctgctcgtgggttccagcctcgaggggtnaaattgngctgactcagtcctccagtacctttcgagttctgtacaacctaccgaaaaggacgaaaacgtccaaccatccaccgtcggccggcagtcgagacgtcgttaggtagtagtacttaccacgtcggtacagacaacgacgccgaggtctacgtacctaaccgaaacgtcctacctacctaactaccgtaaacgttagtcgtaccctttacccgtaacgtttccccttacgtaccggtacccggggttcccccctacggtacgggtttaccgaggtttacgggacgtaaggttcgggtacttaccggtacgggtaacctacttaccgtttacccaccccttacaaacctaacttaacgaacgttacgtacccgtaggaaacgtcgtaaggtaagtacgttacgtacgtacgtaccttaacgtttaacgttacgttacgttaacctagttaacccgtaaacgtttaaccgttaaccgttttaaacccgtttaaacccgttaacgtaaaacgggtttaccttaaacccgtttaccccggtaaaaccccgggtttacccggaaaaccccgggtaacgggtaaaccccggtaaaccggttaaccggttaaaccgggtaaaacggttaaaaccggtttaaaaaacccggg

SEQ ID NO: 171270 - DNA, 769 bp, Homo sapiens
  misc_feature: GYAE6OF01A0G38.27.78.H01.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgaggggtanaaattgtgctgactcacgtctcagtcttacngtctgtacgacctacgaaaggagtaaacgtccaaccactccaaccgtcggcccggacctacgtcgaaggaggtcggtttaggtaacgttacgtacccttaacgaccgtaggtaccgacgaccgaagacggacccgaggtacacggtaccaaccaaacgtcctacctagaacttacgtaaaggttacttccggtaccctttaccctacgtttcccgttacccggtacccgggtaacccggggtttccccgttaaccgggttaccggtttcggtaaccggggttggacgttacggtacggttacgttacgggtacgggaacccttaacgtacccttacccaccccgttacaaaccgtactaaccaacgttacgtaccgtaacggtaacgacgtaaacgtagtcgtcggtacctagtaacgttaacttagttactcgtactaacgttacgtaaccgttactaacccgttactacgtacgttaagtccgtacccttacggttaccgaacggtaacccggaccgtaaagccgtaaggttaacggaaccgttaacgtaaacgg

SEQ ID NO: 171271 - DNA, 615 bp, Homo sapiens
  misc_feature: GYAE6OF01ECFEI.27.78.H01.1.454.CMB.1.raw
  modified_base (602)..(602): a, c, t, g, unknown or other
  misc_feature (602)..(602): n is a, c, g, or t
tcagagcgtcgtctcacgaccggtgctcgatttagtgtgagtagtttgggtttggggggcatgagacaaaactgacaagtcaaggcaggaagatgttgccatcacaactcattgggtttctgctgctctgggttccagcctccgaggggtgaaattgtgctgactcagtctccagtactttcagtctgtgactaccgaaaaggagaaacgtccaccatccacctcggccgggccagtcaggagtcggttaggtagtagtacttacacgtcggtaccagacagaacgccaggtcagtcctaccaaagcctccctcactacaagtactcgtcctttacccagttcctttcctcggtaccgggttcccctcggtacggttcaggtggcaggtggtactcgtggacacgtacttccaccctcaccatacaatacgccgtaggacacgtagaagatcgctacgtacctaactttacttactgtacatacgtagtaacgttaccttaacctttacctacgtagttctacttaccgtaccgtaccggaacgaacgggacacgtacgtacggaaacgtaagttaaaccgagtaggtcgacgtcgactacncttcgtgtttacc

SEQ ID NO: 171272 - DNA, 581 bp, Homo sapiens
  misc_feature: GYAE6OF01ADOFA.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtatcagcagaagccaggtcagtctaccaaagctcctcatcaagtatcgtccttcccacgttcccttcctcgtaccgggggtccccctcggtacggttcagtggcgaggtggatcgtgggacactatttaccaccctacaccactacaactacgaccgtggaacgcgtaggaagtactgactgacctaactttagttaccttgttactataccaagtacgttaccttaacctttacctacgtaacgtgtaactccctaccgtcggtaccgaacggacaccggactgggaagtaaacgg

SEQ ID NO: 171273 - DNA, 612 bp, Homo sapiens
  misc_feature: GYAE6OF01AK2F9.27.78.H01.1.454.CMB.1.raw
  modified_base (412)..(412): a, c, t, g, unknown or other
  misc_feature (412)..(412): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtccaccatccaccgtgcccgggcagtcagagtcgttggagtagcttacactggtaccagcagaagccaggtcagtcaccaaagcctcctcatacaagtatcgtccttcccagttcccttctccgtacggggtcccctcggaggttccaggtcggcagtggatcgtggacactactttccaccctcaaccatacaaatcgaccgtaggaacncgtagaagagtcgcgtcgtacgtaacttattaccttgtactagtcctaacggtacttaacctttactttaacctactaacggttctaacttaccgtacccgtttacggacccggtaaacgggaccaccgaacgttggaaacgtaacgttaaacggaacgtggtaccggactcgacctactacttccttcgtctttacccg

SEQ ID NO: 171274 - DNA, 657 bp, Homo sapiens
  misc_feature: GYAE6OF01D4K8M.27.78.H01.1.454.CMB.1.raw
  modified_base (262)..(262): a, c, t, g, unknown or other
  misc_feature (262)..(262): n is a, c, g, or t
  modified_base (536)..(536): a, c, t, g, unknown or other
  misc_feature (536)..(536): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctcaggggtgaaattgtgctgactcagtctccagtactttcagtctgtcgactccaaaggagaagtcaccatcacctgccgggccagtcagagcgttggagtacgtctacacgtcgacagcagacncgagcagtactaccaagtctctacatacgagtactcgtcctcctacgtccttactaccgggtaccgggttcccctaggttacggtcgtacggtcggtacgtaggttacgacgtcggtacgggtaacctacgttactttaccaaccctccgaacctattaccaacgtaacgtccgtaaggaactacgtagaacgtagtcgtacgtacgtaacttaactttaacgtactcgtacaacttcgaagttacttaacctttacctttaacgtacgtagtnttacctcgttaaccgtaccggaacggaacgggtacaaccgggtagtaacgggaaacgttaaacggttaaacggcttacgggtacctacgtaccgtacctacccttaagttcgttaccgtcc

SEQ ID NO: 171275 - DNA, 536 bp, Homo sapiens
  misc_feature: GYAE6OF01D7A72.27.78.H01.1.454.CMB.1.raw
  modified_base (149)..(149): a, c, t, g, unknown or other
  misc_feature (149)..(149): n is a, c, g, or t
  modified_base (412)..(412): a, c, t, g, unknown or other
  misc_feature (412)..(412): n is a, c, g, or t
  modified_base (511)..(511): a, c, t, g, unknown or other
  misc_feature (511)..(511): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtnaaattgtgctgactcagtctccagtactttcagttctgtgactaccgaaaggagaaagtcaccatcacctgccgggccagtcagagtcgttggtagtagcttacacgtggtaccagcagaacgccaggtcagtctaccaaagctcctcatcaagtatcgccttcccagttcccttctcgtaccgggtcccctcggtagttccgagtggcaggtggatcgtgggacacgtacttccacccctcaccatacaatacgcgtggaanctagaagtgtgctgactaacttattactgtcatcagtactacttactttacagtatgactctaccgtcgacgacggacacgactaggaacgtataacgntcgtagctacgccactatctgttcc

SEQ ID NO: 171276 - DNA, 648 bp, Homo sapiens
  misc_feature: GYAE6OF01BNXQ3.27.78.H01.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (445)..(445): a, c, t, g, unknown or other
  misc_feature (445)..(445): n is a, c, g, or t
  modified_base (476)..(476): a, c, t, g, unknown or other
  misc_feature (476)..(476): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccggccagtcagagtcgttggtagtagcttacacgtcggtaccagcagaagccaggtcagtcctaccaagcctcctcatacaagttatcgtcctttcccacgttccctttcgtccgtaccggggttccccctcggtacggttcgaggttcggctaggtcggtactcgtagggaccactactttcccaccctcaccatactaacgtacgccgtaggaagcgtaggaagtntcgtactacgtactaactttattactcgtanactctagtacgttacttaaccgtttaacctacgtaagttcgtaacttaccgtacccgttaccggaccggtaaacgggacctaacggtaaccggtagggtaacgttaaacgttaaacggtaacgttcgggtacgtaccgtacgtaccctaaccgtacttccgtacgttacccg

SEQ ID NO: 171277 - DNA, 690 bp, Homo sapiens
  misc_feature: GYAE6OF01EBLAH.27.78.H01.1.454.CMB.1.raw
  modified_base (123)..(123): a, c, t, g, unknown or other
  misc_feature (123)..(123): n is a, c, g, or t
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatacttaaaagaggttctttctctgggatgtggcatgagacaaaactgacaagtcaaggcaggaanatgtgccatcacaactctagtttgggtttctgctgtctcgtcggttaccagtccgtcgaggggttataagttgtgctagactcgtacgttcctactagttacttcgagttctgtacgtacgtaaccgaaaaggagtaaacgtccaacctactaccgaccgtcgggcccggactaggtacgaggtacggtcggtttaggtaagttacgtaccttaacgtacgtacggtaaccaggacgaagaaccgccgtaggttactacgtacctaacgaacgtccttacctacataacgtagtacncgttacctccgttacgtctttcgccggtaccggtccctaggtacgtagaggtacggatacgngtactcgtacggaactaccgttactccacctactatacacgtatcgacgtagagacgtagaatgtacgactagttaacgtaacttacgtactgttaaaccagtactaacgttacttaacgttaaccttcgtaatacggtctaactaccgttaccggtaaccgaacggtaacgtactaacggtagtaacggtaaattaaacggtaaacg

SEQ ID NO: 171278 - DNA, 781 bp, Homo sapiens
  misc_feature: GYAE6OF01BUQQH.27.78.H01.1.454.CMB.1.raw
  modified_base (217)..(217): a, c, t, g, unknown or other
  misc_feature (217)..(217): n is a, c, g, or t
tcagagcgtcgtctcacgaccggtgctcgatttagtgtgagtagtttgggtttgggggcatgagcaaaactgacaagtcaaggcaggaagatgttgccatcacaactctattggtttctgctgctcgtgggttccagcctccgaggggtataagttgtgtctgactcgacgtcctaccgagtactttcgagtctgtacgtacctaaccgaaaggtanaaacgtccactactaccaccgtcggccggactagtacgaggtacgtcggttaggtacgtacgtacttaacgacgttacgaaaccaacgaacggacgtccgtaaggttaccgacgttaccgtaaccgaacgtcccttacctacgtaactacgtaaagttcgtaccgttacccttaccgtaccgttcccgttccgtacccgggtacccgggttccccgtagggtttacggttaccgacgggtcggtacgtaggttacggtacgtaccggtacggtaacctaccgttaccgttacccctaacccgtccaacgttaactacgtaaacgtcgtaccgtaagggactaaggacgtaagtccttacggtacttaacgtaaccgtttaaactacgtttaccgtacgtaaccgtatacccggtagtttaaccgtttaacccttacgtttacctaacgagttacctacgtcccgtacgtacgaaccggtaagaccgtaacgtacgtaacggtaactaaaccgtaggccgttggtacccactccgaaacttccagttttccaggtttcctacccg

SEQ ID NO: 171279 - DNA, 715 bp, Homo sapiens
  misc_feature: GYAE6OF01DITRT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgtaaattgtgctgactcagtctccagtactttcagtctgtgactccgaaaggagaaaacgtcaccatccaccgtcgccgggccagtcagagtcgttggtagtacgtcttacgacgtcggtaaccagacaagaacgccaagggtcctagtccaccaaagtcctcctcattcgaaagtatcgccttcccagtccttcgtccgacggggtcccctggagttcagtcgcagtgatcgaggactacgtacttccaaccctcaccgatacaaagtacgtcgtaaggaatccgtaagaagtatcgtacgtacgtaacttaaccgtttaattaccgttacgtacgtaacttacgtaacgggttaactttaaccctttaaccgttttaacccgttaagtaaaccggtttacgtaaaccgtttaccccgtaaacccggttttcccggggaaacccggttaaacggggtaaaccctaacggtaacggttaacgggtaaacggtaaacgtttaaaaaccgacggtttacgggtacggacctacggtaccctaaacgtacttaccgttcgttctttacccgg

SEQ ID NO: 171280 - DNA, 697 bp, Homo sapiens
  misc_feature: GYAE6OF01DAJMI.27.78.H01.1.454.CMB.1.raw
  modified_base (356)..(356): a, c, t, g, unknown or other
  misc_feature (356)..(356): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaaggagaaacgtcaccatccacctcggccggccagtcagagcggttggtagtagcttacacgtacggtaccagacgaagaacgccgagtcgagtacctaccaaagtcctacctacatactaagtatcnccttccacgttccttcgtaccggacgggtcccctggtaacggttcaggtcgcgtaggtcgagtcgtcgggaacactactttcccaccctacaaccctagtactaacgtacgtacccgtagggtaacgtaccgtagaacggtactggtaccgtagtaaccttaaaccttttacgttaaccgttgtaacctaacttaccgtaacggtaaaccggttttaaccttaacccgttttacccagttaaccgttacggtaccttaccccggtacccggtttacccggaacccgtaacggggtaacccacggtaaccggtaacgggtaaacgtaaacgttaaaaccggg

SEQ ID NO: 171281 - DNA, 769 bp, Homo sapiens
  misc_feature: GYAE6OF01ANQ8X.27.78.H01.1.454.CMB.1.raw
tcagagcgtcgtctcacgaccggtgctcgatttagtgtgagtagtttgggtttggggatacttaaaagaggttctttctctgggatgtggcatgagcaaaactgacaagtcaaggcaggaagatgttgccatccacaactcattgggtttctgctgctcgtgggttccagcctccgtaaggggtttaaattgtgctagactcagtctccagtactttcagtctgtcactaccgaaaggagaacgtccaccactccacgtcggcccggacagtaccaggcgtcggttaggtaagtacgtactttacgacgtcggtaaccaggaccaaggacgccgaggtccacgttccaccaacgtcctacctactactactaaagttcgtcctccttacccgtacgttccctttaccggccgggttaaccccggggtcccctaggtacgggtttcgacggttacgggaccggtagttcggtaaccgttacggtaccgggtaacctaaccgttaccgtttaccctacccccgtactaaacccctacttaaccgtaaacggttaccgtaccggttaacgggtaacgtaccggttaaaggtaacgtccgttaacgtaccgtaaccggttaacctttaaaccgtttacctttacggttaccgttaaccttaacgtaacgttaacggttaaccctttacctttaaccgttaaccgtacgtaacgtacgttcctacccgtacgtaccggaactacggactacgagtaggaacttagtaacggtcg

SEQ ID NO: 171282 - DNA, 751 bp, Homo sapiens
  misc_feature: GYAE6OF01AWCC4.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgtaattgtgctgactcagtctccagtactttcagtctgtgactaccgaaagggagaaatcaccactccgaccgtggcccgggccagtccgagacgtcggtttaggtaagtggtacctttacgacgtacggtaccagtacgaagtaacgcctagggtactacgtacctaccaaaggcccttacctactacttaaccaaggttacgtccgtaccctttcccgtacgtttccctttacgtaccggtaccggggttccccttagggtacggttacgtacggtcggacgtacggtggtaacgtcggtacggactaccttacttcccgacccctacacctactaactaaacgtacgtccgtaaggacgtacgtaggtaacgtagtcgtactacggtaactaacgtttacttaacttcggtaacctacgtacgttaacgtacttaaccgtttaacctttaccgtaacgtagttacgtaccgttaccgttaaccccggtacgtaccggtaaacgggacgtaaccggaacgttaacgggaacgttaaaccgttaaacggtacggtttcggtacgtacgtcgtaactaccgttacgttcgttcgttacttacccg

SEQ ID NO: 171283 - DNA, 801 bp, Homo sapiens
  misc_feature: GYAE6OF01C69P1.27.78.H01.1.454.CMB.1.raw
  modified_base (182)..(182): a, c, t, g, unknown or other
  misc_feature (182)..(182): n is a, c, g, or t
  modified_base (684)..(684): a, c, t, g, unknown or other
  misc_feature (684)..(684): n is a, c, g, or t
tcagagcgtcgtctcacgaccggtgctcgatttagtgtgagtagtttgggtttggggatacttaaaagaggttctttctctgggatgtggcatgagacaaaactgacaagtcaaggcaggaagatgttgccatcacaactcagttggtttctgctgctctgggtccacgcctcggagggtanaattgtcgctgactcacgtcctccagtacttcagttctgtcgaacctaccgaaaaggtaagtaacgtccaacctactccgccgtccggcccggaccaggtacaggtacggtcggttaggtacgtactaccttacgacgtacggtaaccgagacgtaaacggacggtaccgtaacggggtcctaaccgtacccgttaaccgaaaccgtccttaccctacctaaggtaacctaaacgttcgttacccttacccttacccgtaacccgtttccccgtttccggtacccgggttaccccggggttaccccgttcggtacgggtttaccgtaagggtccggtacggtagggttaccgtagggttcccgggaacggtacccttaaccgtttcctttaaccccctacccctaacctaaacccgtaactaacgtaaagtcccggtacgttaggacctagtacgaagtgtaccggcttaacgttacctaaactttcgttaccgtctttaanacgttaacgtaccttaacgttaacctttaaccgtacgagttacgtaccgtaccttacccgtaccggtaccggaacggtaacgtaccgaacggtagtaacgtaaacgtaacgtaacgg

SEQ ID NO: 171284 - DNA, 615 bp, Homo sapiens
  misc_feature: GYAE6OF01B3DW8.27.78.H01.1.454.CMB.1.raw
  modified_base (308)..(308): a, c, t, g, unknown or other
  misc_feature (308)..(308): n is a, c, g, or t
  modified_base (438)..(438): a, c, t, g, unknown or other
  misc_feature (438)..(438): n is a, c, g, or t
  modified_base (608)..(608): a, c, t, g, unknown or other
  misc_feature (608)..(608): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcaggggtgaaattgtgctgactcagtctccagtactttcagtctgtgactccaaaggagaaagtcaccatcacctggccggccagtcagagcgttgggtagtagcttacacgtggtaccagcaagaacgaccgaggtcagtcctaccaacgtctcctcatacaagttntcgccttcccacgttcccttctccggtaccggggttcccctggtacggttcaggtcggcgaggtggagtcgtgggacactacttccaccctcaccctatacaactacgccgtaggaagtcgtaggaaatntcgactagactaactttattactgtcatacgaagtacttacttaacctttacacgtagtcgacttcccgtacccgttacggaccgaacggggtaccaccggtagtacggaacttaaacggttaaaccggtacgtacggtacgaccgtacgaccctaaccgttactccgtnttacccg

SEQ ID NO: 171285 - DNA, 870 bp, Homo sapiens
  misc_feature: GYAE6OF01BLS7B.27.78.H01.1.454.CMB.1.raw
tcagagcgtcgtctcacgaccggtgctcgatttagtgtgagtagtttgggtttggggatacttaaaagaggtttctttctctgggatgtggcatgagcaaaactgacaagtcaaggcaggaagatgttgccatcacaactctagtttgggtttctgctgcttcgtcgggttccagccctcggaggggtagtaaattgtgctgactctacgtcctcctagttacttcagttcgtagtacgacctaacgaaagggtaactaaacgtaccaacctactaccgaccggtccgggacccggtacctacggtacgaggtacggtcgggtttagtagtacgtacttacgtacgtacggtacacgacgacgaccgacgtacggtacaccgtactaaccgaacgtcctaccctatacgtacgtaacgtactccgtcccttacctacgttcccgttaccgtcccggggtacccgggttcccgtacgggttacggttacggacggtcgggacgttacggtggtacgttaccggacggtaccttaccgtacctttaccccacccgtactaacctaactaacgtaacgttaccccggagggttaccggtaaacgtaccgttaaaggaaccgttggtaaccgtttaccgtaacccttaaacgttttaacccttttaaacggtacgtttaccttaaccttaacgttaccgggttaaactttacccggttttaaccctttaacccggtttaaccgtttaacggtaaaccgtttacgtttaccccgtaacccgggttaaccggtaacccgggtaaaccgggaaacccggttaacgaaccccgggttaagggttaaacccggttaaagttaaaaccgggtaaaccggg

SEQ ID NO: 171286 - DNA, 712 bp, Homo sapiens
  misc_feature: GYAE6OF01ENC7R.27.78.H01.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (503)..(503): a, c, t, g, unknown or other
  misc_feature (503)..(503): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccaggggtnaaattgtgctgactcagtctccagtactttcagtctgtgactaccaaagganaaagtcaccatccacctggaccgggccagtcgagacggtcgttaggtagtacgtacttacgacgtggtaacagacagaacgccgaggttcagtactacaaacgctcctacatacaagtactcggtccttcctaacgttccttaccgtcgtaccgggtcccctacggtacggttcgaaggttcggacgtaacggttggtaacgtcggttacgggaactaccgtaaccgttttaccaacccgttaccaaccgtactaactaaacgtacgtaccgttacgggaacgtcgttaagaaggtatcggtanacgtaactaaacgtttacgtttaacctggtacaacttaccgaagtaacgttaaccttaacctttacgtacgtaaggtcgtaacgttccgtaaccgttcccggaacgtaaccggaacgtaaccgtacgttaacggagttaaacgtaaaaccggtacgttacgggtacgtaccgtacgtaacctacctaatttcgttcgtacgtttacccg

SEQ ID NO: 171287 - DNA, 730 bp, Homo sapiens
  misc_feature: GYAE6OF01EFAL7.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgtgctgactcagtctccagtactttcagtctgtgactacaaagggagaaacgtcaccatccaccgtgccggcagtcgagagtcgttaggtagtagtcttacgactggaccagcaagacgcgaggtcacgtctaccaaacgtctcctctatactaagtctcggtccttcccgtacgttcccttacgtccggtaccggggtccccttacggtacggtttcgagggtcggtacgaggttcggtacgttcggtagggtaacctacgttacctttacccaccctaccctaaacccgtatacctaaacgtacggtacccgtaagggaacgtcgtaacggaagtagtcgtacgtactaacttaacgtttattacgtatacacttacgtaaggttaaccttaactttaacgtttaaccgtacgtaaacgttcgtaaaccgttcccttaaccgggttaccggaaccggtaaagggtaccctaacggtaccgggtaacgggtaaacgtaaacgtttaaaacggtcggttagggttaccgggtacctaccggtaccctaacgttacgttacgtttccgttcctttaaccc

SEQ ID NO: 171288 - DNA, 893 bp, Homo sapiens
  misc_feature: GYAE6OF01CJR8S.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcaacaactcattgggtttctgctgctctgggttcagcctcgagggtagaattgtgctgactcagtctcagtactttcagtctgtcgactacgaaaggagaaagtcaaccatccaaccgtcggcccgggaccaggtcaggtacgtcggttggtaagtagtacttacacgtggtaaccagcaagagaccgaggtctacgtacctaaccaaacgccttacctacgaacttacaaacgtattcgtaccttacccgtaacggttccttttaccgtaccggtaccggggttacccccttacgggtacggtttaccgacggttacgggaccgtacggtagggtacgttccggtaacggggaacctaacgttaacgttttacccgaaccccttactaaaccgtaacttaaccggtaaaacgtaaccggtaccggttaacgggtaaacgtccgttaaacgggtaaacgtaacgttacggtaccgtaacggttaaaccctttaaaacgttttacccgttaagtttaccgtaaacgtaaaccttaaccggtaaaggtttaaaccgtttaaacccgtttttaaccttttaaacccgacgtttaaacgggttacctaacggttaccccttaaacccgggttaccggaaacccgggttaaccgggaccggtaaacccgtaaacgggttaacggggttaaaacttaaaaccgggtttaaaaccggtaacgggttttccggaaacgggtaccctttaacggaccccgtaaaggttaccctttaccggttcgttttacccgttaaaccccg

SEQ ID NO: 171289 - DNA, 802 bp, Homo sapiens
  misc_feature: GYAE6OF01D1LV8.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaattgtgctgactcagtctccagtactttcagtctgtcgactaccgaaaggagaacgtccaccactccgaccgtcggacccgggacctaggtacgaggtacggtcggttaggtaggtacgtacctttaacgaccgttacggtaacccaggaccgaaggaacgccgacggtactacgtacctaaccgaaacgtccttcctacgactacgtaacgttactccgtcccttcccgtacgttcccttaccgtccggtacccggggttcccctacggttacggtcgtacggtacggcgtaggtggtactcggtacggtacctacttaccgttaccacccctaccaacctactaacgtaactaccggtaccgtaggaacgtccgtaaggtaacgtactacggtacttacgtaacctttaacgtttactttaacgtcgttaaccttaacgtaccgttaaaggttaacccgttttaacctttaacccgttttaaccgtacgttaacgtaccgttaaccttaccccggttaccggttacccgggaacggtaaacccgggaaccgaaccggttaacggtaacggtaaaacgttaacgttaaaccggtcgttacgggttccgaccggtaccacccttaacgttccttcggttccgtttaacccg

SEQ ID NO: 171290 - DNA, 673 bp, Homo sapiens
  misc_feature: GYAE6OF01BX510.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattggtttctgctgctctgggtccagcctcgaggggtgaaattgtgctgactcagtctccagactttcagtctgtgactaccaaagggagaaagtccaccatcacctggccggcagtcaggagtcgttaggtagtacgtcttacgactggtaccagacagaagccaggtcagtcctaccaagtcctacctcatcaagtactcgcttcccaagtccctcgtcgtacggggtcccctaggtacggttcgaggttggccgtaggttcgggtaactcgggtaggggaaccgtaccttacgttttccccaaccccgtcccaaccctaactacctaaacttacggccgtaacgggaacggtcctaggaaacgacttacgacgtttacgacgttaaacctttattaccttagtacctaataccgtaagtaacgttaaccttaaccctttaccgtaactaacgtcgtactacccgtacccgtttccggaacccgtaaacgggtacccaacggtaacgtcgggtaaaacgtagttaaaaccgg

SEQ ID NO: 171291 - DNA, 591 bp, Homo sapiens
  misc_feature: GYAE6OF01EJZU1.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagcccaggtcagtctccaaagctcctcatcaagtatgccttcccagtccttctcacgggtcccctgaggttcagtggcagtggatcgtgggacactactttccaccctacaccatcaaactacgcctaggaacgccgtagaacgatcgactacgactaaactttacgttaacttcgtctatacaagtaacgtacttaaccttttacctactaagtgtaattcctaccgttcggaccgaagggaacccacgtaacgtaggaacgtaacgttaaaacgaaccgttggaccgggtactcggaccctaaccgtaactcgttacgttcttaacccg

SEQ ID NO: 171292 - DNA, 957 bp, Homo sapiens
  misc_feature: GYAE6OF01DUC3I.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgagggtgaattgtgctgactcagtctccagtactttcagtctgtcgactaccaaaggagaaacgtccaccatccaccgtggcccgggccagtcagaggtcgttggtagtacgcttacacgtggtaccagcagaagccaggtcacgtctaccaaagcctcctacataccaagttactcggtccttcccacgttccttcgtccgtacgggtcccctcggtacggttcgacggtggacgtaggtcggacgttcggtagggacctacgtacctttcccgacccctacgaaccctatacctaaagttacggacccgttagggaacgtaccgtaggtaaacggtacgttcggtaaccgttacggtaacctttaaaccgttttaacgtttaacccggtttacgtttaacccgttaacgtttacccggtaaacgggtttaaccccgggtttttaaaacctttttaaacccccgttttttaaacccggttaaacccggttaaaacgggttttaccgggtaaaccccgtttttaaccccccgggttaaaccccgggtttttaacccccggggggaaacccccgggtttaaaaacccggggggtaaaccccgggttaaaaccccggggtttaaaccccgggggttaaacgggggtttaaaaaacccgggttttaaaaacccgggtttttaaaaaacccccgggggttaaaaccccgggttttacgggggtttacccgggttaaccccggttttaacccggggtaaacccccttaaacccccggtttaacgggttttaccccgttttaccggggttttaaaccccccg

SEQ ID NO: 171293 - DNA, 766 bp, Homo sapiens
  misc_feature: GYAE6OF01EAUL9.27.78.H01.1.454.CMB.1.raw
  modified_base (451)..(451): a, c, t, g, unknown or other
  misc_feature (451)..(451): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctcgtcggtcacgcctcggagggtataattggtgctgactcgagtcctaccattactttcgagtcgttgtacgtaccgtaaccgaaaaggaagaaactaccaaccaacgtcccgtaccgccggacccgggtaccgacgtacgaggtacggttacggttaggtacgtacgttaccttaaccgacggttacgaaccgaacgacgaaaggaaccgtccgacggtacacgttaccaacgtaaactcctcctatacgtagaacgttcgtccgtcccttaccgtccgttaccgttcgtaacccgggtccccgggttaccgtacggtaacggttcggnggttacggctagggtacgtacttacggtaccgtaacctaacttcccgtacccccacctaaaccgtactaaactacgtaaccggtaccgtaccggtaaggacgtacggtaagaagtcgtactcgtaactaacgttacttacgttatacgttatacgtaacgtacgttacgttaacctttacttaacctaacgttacgtacctacgttacccgtaccgttaccggacgtaacgaaccggtacgtaacgtaagtaacgtaaacgttaacgacggttgacgtacgtacgtaacctacctattcttacgtccttaacccg

SEQ ID NO: 171294 - DNA, 788 bp, Homo sapiens
  misc_feature: GYAE6OF01A59LS.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactacgaaaggagaaacgtcaccatccaccgtcggccggccagtcagacggtcgttaggtagtagcttacacgtcggtaccagcaagaacgccgaggtacacgtaccaccgaacgcctcctcactacaagtactcgtccttccgacgttccttcgtaccgtaccgggtcccctcggtacgttccgtaggtcgacgtacggtcggtaacttcggtacgggtaacctacgttacctttaccccgaaccccgttacctaaccctacgttaaccgaaacgttaccggtacccgtaagggtaacgtaccgttaacggaaacggtacgttaccggtaaccgttacggtaaccctttaaacgtttttaccgttaaccgttcggttaaccttaacgttaacccgtaacggttaaccgtttaaacccctttaaaccgttttaaccccgtaaacgttaacggtaccggttaacccgttaccccgtttaacccggttacccgggtaaaccggtaaacccgggtaacccggtaacccggtaacggttaacgggtaaaacgtttaaaccggttaaaaccggg

SEQ ID NO: 171295 - DNA, 606 bp, Homo sapiens
  misc_feature: GYAE6OF01EIAY8.27.78.H01.1.454.CMB.1.raw
  modified_base (428)..(428): a, c, t, g, unknown or other
  misc_feature (428)..(428): n is a, c, g, or t
  modified_base (504)..(504): a, c, t, g, unknown or other
  misc_feature (504)..(504): n is a, c, g, or t
  modified_base (582)..(582): a, c, t, g, unknown or other
  misc_feature (582)..(582): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccacctggccggccagtcagagtcgttggtagtagcttacactggtaccagcagaagccaggtcagtcctccaaagcctcctcatcaagtatgtccttccctagttcccttccgtccgccgggggttcccccttcgggtaggtttccaggtcggcaggtggatcgtgggactacgtactttcccaccctccaccctataccaatacgcctagggaacncgtagaagatcgctcgaactaactttatttacttagtctaatctaagtacgttaacttacctttacctactaagtntacttccgtaccgttccggaacgaacgggaccacggtacgtaggtaacgtaaacgttaaacgacgtggtacgcgtacnccactacttcttcgttccttaccg

SEQ ID NO: 171296 - DNA, 729 bp, Homo sapiens
  misc_feature: GYAE6OF01A124X.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaacgtcaccatcacctgccgggccagtcagagtcgttggtagtagcttacacgtggtaccagcagaagccaggtcagtctccaaagctcctcataccaagtatcgcttcccagttcccttctccgtacgggttccccctcggtaggttcaggtcggcctaggtcggaagtccgtagggacctacgtactttacccgacccctacaaccgtataccgaaacgttacgacccgttagggaaacgtccgtaggtaaaggtactacgtccgttacgtaacctaacgtttaactttaacgtcgttacctaacgttaccgtaagttaacgtttaaccttaaccgttttaacccgttacgtaaagggttacgttaaaccttcccgtaacccgtttaccgggaaccccgtaaaacggggtacctaaccgggtaaccggtacggtaaacggttaaaccgtttaaaaacggtaaccgttaccggggttagttacccggtacgtaacccgtaaccgttaccgttccggttcgtttaccccg

SEQ ID NO: 171297 - DNA, 575 bp, Homo sapiens
  misc_feature: GYAE6OF01A9474.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagtcgttggtagtagcttacacgtggtaccagcagaagccgaggtcagtctaccaaagctcctcataccaagtatcgtccttcccacgttccttcgtcgtacgggtccccctgtacggttcacggtcggctaggtggatcgtgggacactatttccaccctcaccgtatcaatacgccgtaggaacgctagaatgtcgctgactaacttattactcgtactatcgagtacgttaacttacctttacctactaagtactacttacctaccgtcggaccgaaggaccacgacgtacggaagtaagttaaacgactggtacgtcgtagacctactacttcgtcgttacccg

SEQ ID NO: 171298 - DNA, 656 bp, Homo sapiens
  misc_feature: GYAE6OF01CGWII.27.78.H01.1.454.CMB.1.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcagttgggtttctgctgctctgggttccagcctccgaggggtgaaattgtgctgactcagtcctcagactttcatctgtnactacaaaggagaatcaccatacacgcggccggccagtcagngtcgttggtagtagtcttacncgtggtaccagcgagacgccgaggtcacggtcctaccgaacgtcctcctcaacgtacaagttactcgtaccttcccgacgttccttcgtccggtacccgggtcccctcggtacggtcgtacggtggacgtaggttcggagttcgtacgggaactaccgttacttaccgacccctactaaccctataccaacgtaccggtactacgggaactcggtaagaacgtacgtcgtaactgtaaccttaacgttattacccgtgtacagttacgataaccggttaactttacccttacttaacgtaagtacgtacttacccgtacccgtaccggtaacgaccgggtaacacggtataacggtacgtaaacgttaaaccgg

SEQ ID NO: 171299 - DNA, 926 bp, Homo sapiens
  misc_feature: GYAE6OF01DX9FX.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactaacaagtcaaggcaggaagatgttgccatcacaactctattgggtttctgctgctcgtcggttccacgcctccgagggtagaaattgtgctcgactcagttcctccacgtactttcgacgtctcggtacgtaacctaccgaaaaggaagtaaacgtaccaaccgactacccgtaccgtccggaccccgggacctaacggttacgaacggtacggttaccgggtttacgggtaagttacggtaccgtttaaccgtaccgttacgggtaaccgacggaaccgtaacggaacggccgtacggtaccgtacgtacccgtaaccgaaacgtcccttaccctactactaacgaacgttactaccgtcccgttaccgtccgttcccgttaccggtaccgggtaccccgggttacccgttacgggttacggttacggtacggttcggacgtcggtacggtacgttccgggtaacgtaccgtaaccttccgtttaccccaccctaaccgtaactaacgttaaccgtaacttaccggtaccggttaaggaacgttcggtaaagtaacgttagtacccgttacgtacgttaaaccttttaccgtttaacgttacgttactaaccgtttaacctaagggttaaccgtttaaaccgttttaacccgttttaaaccgttacccgttaaaaggtacccggtttaaccgttacccgttaaacccccgggtttaacccggttaacccccgggaacggttaaaacccggggtaacccttaaacgggtaccggggttaaaaggtttaaaacccgttaaaacggttttaaaccgggtaccggg

SEQ ID NO: 171300 - DNA, 794 bp, Homo sapiens
  misc_feature: GYAE6OF01CJESQ.27.78.H01.1.454.CMB.1.raw
tcagagcgtcgtctcacgaccggtgctcgatttagtgtgagtagtttgggtttgggatacttaaaagaggttctttctctgggatgtgacatgagacaaaactgacaagtcaaggcaggaagatgttgccatcacaactctattgggtttctgctgctcgtcgggttccacgccgtcgaggggtagtaagttgtcgctgactcgacgtcctaccagtactttcagtcttgtacgaacgtaccgaaaaggaagtaaacgtaccaacctactaccgaccggtacgggaccgggaccgtagtaccgaggtacggtcggttaggtagtacgtacttaacacgtacggtaccagacgaacgaacgtcgagtctacgtaccaccgaacgtcctacctactacgtacgtaagtactaccgtcccttaccgtacgtttccgttaccggtaccggtacccggttccccgtacggttacggtacgtacggtacgacgtaggtacgtacgtacggtcggaactaccttacgttaccccaaccgtacctaaacgtactaacgtaacgtacggaccgtaaggacgtacgtagaagtacgttcgaccgttacgtaaccttaacgtttagtaaccgtactacgttaacgtaaccgtaacgttaaccgttaacgttttacccttaaacccgtagttaaccggtaccgttaaccgtaacccgttaacccggtaaccccgggaaacggttaacgggtaacccgtaaacggttaaccggtaacgttaaaaccgggttaaacgtttaaaccggg

SEQ ID NO: 171301 - DNA, 813 bp, Homo sapiens
  misc_feature: GYAE6OF01AM8A1.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgcctcgtgggttccagcctccgaggggtnaattgtgctgactcagtcctccagtactttcagttctgtacgactaccgaaaggagtaaacgtccaaccatccgaccgtcggcccggcacgtacgagtagtcgttaggtagtagaccttacgacgtggtaccagacgaagaacgccgaggtcacgtcctaccaagtcctcctacataccgtaagtactcgtcccttcccgtacgttcccttccgtaccggtacccgggttcccccttagggtacggtttcgacggttcggtacgtaggtacggtacgttcggtacggaactaccgttacgtttccctaacccccgtacctaaccctacgtaaccgaacgttaccggtccgtaagggtaaccgtcgtaaggaaacgtgttaccggacgttacgtaacccgtttaaactttacgttaaccgttagtacctaacgttaccgtaaacggtttaacccttaacccttttaaacccgttttacctaacggttaacggttacgtaacccgttacccgttacccggttaaccgggaacccggttaacgggaaccctacgggtaacccggttaaacgggtaacgttaaacggttaaacccggtacgttcggggtacccgtaccgttaaccgacccctaaccttaacgtttccgtttaccggttctttaaccccg

SEQ ID NO: 171302 - DNA, 597 bp, Homo sapiens
  misc_feature: GYAE6OF01E266S.27.78.H01.1.454.CMB.1.raw
  modified_base (241)..(241): a, c, t, g, unknown or other
  misc_feature (241)..(241): n is a, c, g, or t
  modified_base (452)..(452): a, c, t, g, unknown or other
  misc_feature (452)..(452): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtgaaattgtgctgactcagtctccagactttcagtctgtgactcaaaggagaagtcacatcacctgccggcagtcagagtcgttggtagtagcttacncgtggtaccagcagaacgccaggtcagtcctaccaaacgcctcctcactcaagttatcgtccttacccgagttcccttctccgtacggggtccccctcggacggtttcgagtcggctaggtggtacgtcgtgggaactacgtactttccaccctcaccatcaatacgtaccgtaggaacgctagaagtatgtctgacctaacttattactntctactacacgtactacttactttacctagtaacgtgtacttccgtaccgttaccggaccgtaacggaccgtacgtacgtaggtaagtaacgtttaaacggacgttggtacgtcgtacgcctacgaactttccgttgtcttaccg

SEQ ID NO: 171303 - DNA, 717 bp, Homo sapiens
  misc_feature: GYAE6OF01BFTD7.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtgaaattgtgctgactcagtctccagtactttcagtctgtcgactaccgaaaaggagaaagtccaaccatccaccgtcggccgggccagtcgagaggtcgttaggtagacgtcttacgacgttcggtaaccaggaccaaggaacgccgaggtccaagtcctacaaacgtcctaccttacactacaagttactccgcctttcccgacgttcccttccgtcggaaccgggttccccctaggtacggttcgaggtcggactacggtggacgtcggtaggtacctactacgtttcccaacccttctaaccgactaacctaacgtaccgtaccgtaagggaacgtacgtaggtaaacgtagtcgtccgtacggtaaacttaacgtttacttaacgtcgttaacacgttacgtaacgtaaccgtttaacctttaaccctttaaccttacgtaagttaccgtaacttacccgttaaccgtacccggaaccgtaaacggtaaccgaccgtaaccgtaaggtaacgtaacgtaacgtaacgttgtacgacgtacgacctacgtacgttcgtacgttacc

SEQ ID NO: 171304 - DNA, 689 bp, Homo sapiens
  misc_feature: GYAE6OF01A19LH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccacctcgccgggccagtcagacgtcggttaggtagtagcttacacgtcggtaccagcagaacgccaggtcacggtactaccgaaagctcctcatacaagtactcgtccttcccaggttccttctccgtacggggtcccctcggtaggttcaggtcggcaggtggactcgtacgggacctacgtactttacccaccccttacaaccctattaccaaacgttacgaccgttacggaacgtacctaggaacggtagtcggctacgtaacttaacttatttaccgttgtactactacgtaagtaacttaacctttacttttaacctactaacgtcgttaactaccgttaacccggttaccggacccggaaaggtacccgtacggtaccgttaagggtaaccgttaacgttaaaccggtaaccggttacggttcggtacccgtacgtaccccgtacttacgttcccgttgttaacccttacccg

SEQ ID NO: 171305 - DNA, 841 bp, Homo sapiens
  misc_feature: GYAE6OF01EI3XH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaaattgtgctgactcagtctccagtactttcagtctgtcgactaccaaaggagaaagtccaccatccaccgtcggcccgggcacgtcacggagtcggttaggtagtagtcttacgtactacggtaacccagacgtaaggaacgccgaacgggttccaacggttccctacccgaaaacggtcccttacccgttacaacttaccgtaaagttactcggttaccctttaccccgtacggtttccccttttacggtacccgggtacccgggggttcccccgttacgggttaacgggtttccgaagggttcgggaccgtaggtacgggtactccgggtacggggtactaaccgttactttacccacccttaccaacccgtaactactaacgttacggtaccgtaacgggtaacgtacgtaaggaagtacgttcggtacgtacgttacctaaaccgttttaagtttacccgttacgttaaccgtaacgttaccggtaacgttaaccggtttaaccttttaacccgttttaaacccgtaaccccgttaaaggttaccgttaaccttacccgttaccccggtttaaccgggaaaccccggtaaaaccggggtaacccgtaacccgggtaaccggttaacgggtaaacggttaaaaccgtttaaaaccggg

SEQ ID NO: 171306 - DNA, 740 bp, Homo sapiens
  misc_feature: GYAE6OF01D4YOG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccggccagtcagagcgttggtagtagacttacactggtaccagcagaagccaggtcagtctaccaaagcctcctcatctaagtatcgccttcccacgttccttcgtcgtacgggtcccctcggtacggttcaggtcggcgtaggtggtatccgtaggggaacctaactactttacccgaccccttaccgaacccctataacctaaacgtaccggtacccgttacgggaacgtacgtaacggtaaacgtacgtcggtaccgttcggtaacccttaaaccgttttactttaaccgttacgtaccttaacttaccgtaacggttaaacgttaaccccttttaaacctttttaacccctaacgtttaaaacgtcgtaaaccgtttaccccgttaaccccggtttaccccgggaaaccccggtaaaacgggggtaacccctaaaccgggtaaccggttaaaccggggtaaaacgttaaaccggtttaaaaaacccggg

SEQ ID NO: 171307 - DNA, 784 bp, Homo sapiens
  misc_feature: GYAE6OF01BQZKV.27.78.H01.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgagggtagaattgtgctgactcagtctccagtactttcagtctgtgactaccgaaagganaacgtcaaccacnccacctggccggcagtcagagtcgttaggtagtacgtacttacacgttcggaccagaccaaggtaagccgaggtacacgtacctaccaagtcctacctacactaactaacgttactccgtcccttacccgtaacgttccctttcgtacccggtaccggggttccccttaggtcggttaccgtaaggttcggaccggttaggtacgggtacttccggtacgggacctacctttaacgtttacccaacccccgttacaaccctaagttaaccgaaacgttacgacccggtaaggtaacgtccgtaaggaagtacgttacggacgttacgtaaaccgttaacttttacggtacttaacggtacctaagtaccgtaaggttaacttttaacccgtttaacctttaccgtaacttaaaccggtgtacccttaaacccgttcgggtaacccgggacctaaaccgggtaccgaaaccgttcgggtaaacggtaaaccgttaacggttaaaaccggttgttaccgacggtttaacgaccgtacccacccttaggtttcccttccggttctttaaccccg

SEQ ID NO: 171308 - DNA, 723 bp, Homo sapiens
  misc_feature: GYAE6OF01AHLSV.27.78.H01.1.454.CMB.1.raw
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (139)..(139): a, c, t, g, unknown or other
  misc_feature (139)..(139): n is a, c, g, or t
  modified_base (154)..(154): a, c, t, g, unknown or other
  misc_feature (154)..(154): n is a, c, g, or t
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
tcagagcgtcgtctcacgaccggtgctcgatttagtgtgagtagtttggggtttggggatacttaaaagaggttctttctctgggatgtggcatgagacaaaactgacaagtcaaggcaggaagntgtncatcacactntagtttgggtttctnctgtctcgtcggtccacgtcctacggtagggtataagttggtncgtacgtctacgtacgtcctacgtacgttacttcgtacgtgtgtactaaccgacgaaagggaactaaacgtccaaccgtacctaccgtaccggaccggccggaccgtatacggtacggtaaggttcggttacgtacggtcctaactacgtacggtacggtacgacgacgtacggaccgtacggtacctacgtacgacccaacgtactacctctactacgtactaacgtctaccgtactccggtaccgtccgttacggacccgtaccggtccggttacgtacggtacgagtcggtataacggtntacggtaggtaccgtaaccgtactacccttaccaaccgttacgactaacgtaacaacggttacgacggttacgacgtaagtacgtacggtactacggacttaaggttacctaagttcacgttacaacgtaggtacctaataccttaacgtacctacgtataactcgtaacgttacgtccgtaaccgaaggtacacgggtacagtaaacgtagtaaccgtacgg

SEQ ID NO: 171309 - DNA, 689 bp, Homo sapiens
  misc_feature: GYAE6OF01A9X8B.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgcttgactcagtctccagtactttcagtctgtgactaccgaaaggagaaagtcaccatccaccgtcggccggaccagtacgaggaggtacgtttggtagtacgtacttacacgtcggtaccagacgagaacgaccgagtcagtctaccaagcctccacatacaagtactcgtccttcccgtacttcccgttctccggtaccgggtccccgtcggtacggttacgtaggtcggacgaggttggacgtcggtacggtactacctacttcccgaccctaccgaacctaacgtacctaacgtacgtacgtacggaacgtacgtaagaagtacgtacgtctaacgtaccttaacttagttaacttcgtaacctagtaacctaaggttaccttaaccgttaacctttacctaagttaacgtacgttaacttcccgtaccgttacggaccgaacggtaccgtacgtacgtacggtaaacgtaacgttaaacgtacggttggacgtacgtaccgtacctaccttagttcgttcgtccgttacc

SEQ ID NO: 171310 - DNA, 682 bp, Homo sapiens
  misc_feature: GYAE6OF01CXOPZ.27.78.H01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgtaaattgtgctgactcagtctccagtactttcagtctgtgactaccgaaaggtagaaagtcaccatccaccgtggccgggcagtcagngtcggttggtagtagcttacacgtggtaccagcaagtaacgccgaggtcagtcctaccgaaagtcctcctacactacaagtatcgtccttacccacgttcctttcgtaccgtacggggttccccgtcggtaggttcgtacggtggcgtaggtggactcgtacgggactacgtactttccaacccctcaccgtaatactaacgtacgcgtaggtaacgcctaaggaacgtacgtcgtacgtacgtaccttaactttactaacgttcgtactaagtacgtaagttacgttaacctttaactttaacctacgtaacgttacgtacttaccgtaccgttaccggaccggtaaacggaccgtaacgtacggtacggtaaacgttaaacgtaaacggtacgtacggtacggtccgtacgtaccctaacgtacttacgtctttccgttaacccg

SEQ ID NO: 171311 - DNA, 819 bp, Homo sapiens
  misc_feature: GYAE6OF01DFYGD.27.78.H01.1.454.CMB.1.raw
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattggtttctgctgctctgggttccagcctcgaggggtnaaattgnctgactcacgtctcagtacttcagtctgtnactacgaaagganaaagtcacatcacctcgccgggcagtcgagacggtcgttggtacgtagtaccttactacgtacgtaccagcgaagaacgccaggtcagtacctacaagtcctccacacgttacaagtatcgtacctaccacgttccctttaccgacgtacccgggggtaccccttacgggtacggttacgtaacgggttcggacgtaaggtacgggtacgttaccggtacggggtaaaccttaacggtttaccttttaccccgtaacccccgttaacctaaaccccttaactttaacctaaaggttaccgtaacccggttaagggtaaaccgttacggaacgggtaaacctagttaccgggtaccttacggtaaacctttaaacctttaccggttttaacgttaacgttaccgttaattaacggttaacggttaaaccgtttaaaccttttaaaccctttaaacccgtaaccgttaacgggtaaccttaacgttaccccggttaaacccggtttaacccggggaaaccccggtaaaaccgggaccggttaaaaccgttaaggttaaacggtaaaaccgggttaaacttaaaaaacccggg

SEQ ID NO: 171312 - DNA, 613 bp, Homo sapiens
  misc_feature: GYAE6OF01EFREG.27.78.H01.1.454.CMB.1.raw
  modified_base (482)..(482): a, c, t, g, unknown or other
  misc_feature (482)..(482): n is a, c, g, or t
  modified_base (527)..(527): a, c, t, g, unknown or other
  misc_feature (527)..(527): n is a, c, g, or t
  modified_base (587)..(587): a, c, t, g, unknown or other
  misc_feature (587)..(587): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcgagtctgtgactacgaaaggagaaagtcacatccgacctgccggcagtcgagagtcgtttaggtagtagtccttacacgtcggaccagcaagaacgccaggtcacgtctaccgaaacgtcctcctcagtacaaggtatcgtccttcctacgtccttcctcgtacggggtcccctcgaggttcaggtcggcgtacggtggacttcgtacgggactacgtactttccaccctcgacctatacgaacttacggaccttgggaaagtcctagaagtagtcgctacggtaactaactttacttacgttntactatcagtaacgttacttaccttttacacgtagtgacttaccnccgttacggaccgaacggacaccggtaagaggtaaactaacgtaaaccgtagtcgtggtnacgtccaacttctccgttctctaccc

SEQ ID NO: 171313 - DNA, 595 bp, Homo sapiens
  misc_feature: GYAE6OF01ES0HL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagcgttggtagtagcttacactggtaccagacagaagccaggtcagtcctccaaagctcctcatacaagtatcgccttcccagttcccttcctccgtacggggtccccttacggacggtttcaggtggcgaggtggagtcgtggacacgtactttccaccctcaccatcaatacgccgttaggaacgtcgtagaagtactgctgaccttaactttactttactgtactatacgaagtacgttaccttacttacctacgtaagtgtacgttacctaccgttcgggaaccgtaacgggacctacgacgtaggaacgttaaacttaaacggacgttggacgtctacgcaaccttatcgttcgtcttacccg

SEQ ID NO: 171314 - DNA, 712 bp, Homo sapiens
  misc_feature: GYAE6OF01EXGIG.27.78.H01.1.454.CMB.1.raw
tcagagcgtcgtctcacgaccggtgctcgatttagtgtgagtagtttgggtttgggggcgatgagcaaaactgacaagtcaaggcaggaagatgttgccatcacaactcattgggtttctgctgctctggggttccagccctcgaggggtcaattgtgctcgactcagtctcagtactttcagtctgtgactaccgaaaggagaaacgtccacatcacctgccggcagtcagcgcgttgtagtacgcttacacgtgtacagcaagaacgccgaggtcagtcctaaccgaaacgctacctacatacgaagtatcgtcctttacccgagttccctttcgtacgtaaccggggttccccttaggtacggtttcgaacggtcggacgtaaggttcggacgttcggttagggaacctaaccgtacttttacccaccctttaccaaaccacttaacgtaaataccgtaccgtaaggtaacgtctaaggaaacgtatcgtacgtagtaaccttaactttacgttaacgtacgtactacgtactaacggtaacgtttaacctttaaccgtttaaccctacgttaaacgttctaaccgttaccttaaccgttaccggaaccgtaaacggggacctaaaccggtagtaacggtaaagtaaacgttaaacggtaaacggttacgtacggtacgtacgaccctaactcgttaccgttgttaccc

SEQ ID NO: 171315 - DNA, 681 bp, Homo sapiens
  misc_feature: GYAE6OF01BDKSE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccggccagtcagaggcgttggtagtagcttacactggtaccagcagagaccaggtcagtcctccaaacgcctcctcatcaagttatgtcccttccctacgttcccttctccgaccggggtccccctcggtacggttcaggtggcgaggtggtaatcgtgggacactatttccaccctccaacctataccaagtacgacctagggaagtccgttagaagtatagcctagtcctaaacttgttacctggtacattaccaagttacgttaacctttaactttacccgtactaaacggttcgtaacttaccgttaaccccgtttacggggaacccctaaagggggtaacccgtaaccggttaaaccgaacggggttaaacgaaaacgttttaaaaccggaaacggttcgggttaccggggtaaccttacggtaccctaaccgtaacttcccgttacgtttccgtttacccg

SEQ ID NO: 171316 - DNA, 693 bp, Homo sapiens
  misc_feature: GYAE6OF01BIJH9.27.78.H01.1.454.CMB.1.raw
  modified_base (148)..(148): a, c, t, g, unknown or other
  misc_feature (148)..(148): n is a, c, g, or t
  modified_base (548)..(548): a, c, t, g, unknown or other
  misc_feature (548)..(548): n is a, c, g, or t
  modified_base (560)..(560): a, c, t, g, unknown or other
  misc_feature (560)..(560): n is a, c, g, or t
  modified_base (667)..(667): a, c, t, g, unknown or other
  misc_feature (667)..(667): n is a, c, g, or t
  modified_base (679)..(679): a, c, t, g, unknown or other
  misc_feature (679)..(679): n is a, c, g, or t
tcagagcgtcgtctcacgaccggtgctcgatttagtgtgagtagtttgggtttggggggcatgagcaaaactgacaagtcaaggcaggaagatgttgccatcacaactcattggtttctgctgctctgggttccagcctcgaggggtnaattgtgctgactcagtctccagtactttcagttctgtacgacgtacgaaaaggagtaaacggtccaacctatccaccgtcggccgggcaggtcgagacgtcggttagagtacgcttacacgtcggtacagacagacgaccgaggtcagtcctaacaacgcctacctactaatacgaagttcgtcgtacccgttaccctacggtttcctccggtacggtacccgggttccccgtacggtacggtttcgacgggttcggacgtaggttcggtacgtacggttacgggaccttacgtttaccgttaccctaacccgttacaaccgacttaccgtaacgttaccggtacccgagggtaacgtcgtaaggtaaacgtcgtcgacgttacgtaacttaacgtttntaaccgttgtanacggttactaagtacctttaacttcctaactacgaagtctaccgtactacccggtacaacggtaacgacgtacgtaagtaggtaacgtaagaaccgttcggtgaacncgtcaacgtccncttgttccctaccg

SEQ ID NO: 171317 - DNA, 828 bp, Homo sapiens
  misc_feature: GYAE6OF01C51ES.27.78.H01.1.454.CMB.1.raw
  modified_base (122)..(122): a, c, t, g, unknown or other
  misc_feature (122)..(122): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaanatgttgccatcacaactctagttgggtttctgctgcttcgtgggttccacgcctccgaggggtagtaaattgtgctgtactcacgtcctccagtacctttcagttcctgtcgacctaccgaaaaggaagaaacgtaccaaccatcctaccgtcggcccggccagtcgaacggacggtcggttggttaagtacggtaccttaacctacgtacggtaaccagacgaagtaacgccgtaaggtccacggtacctacccgaaacgtcctacccgtactaactaacgtaacgttatccgtcctttaccctacgtttcccgttccgtaccggtacccgggttacccccgtacggttacggttcgtaggtcggtacgtaacggtcgggttactccgggtacgggtaacctaacctttaccgtttaccccctaaccccgtaccccttaaaccctaagttaaccctaaacggttacgtacccgttaagggtaaaccgtccgtaaaggtaacgtacttacggtaccttacggtaaaccttttaaacgttttaaacctttacgttacgtacctaacgttactaacggttaacgtttaacccttttaaactttaccgtaacgtagttacctaacttaaccggtacccggttaccgggaacccgtaaacgggtaccgtaaccgtaggtttaacggaaacgttaaccgttaaaaaccggg

SEQ ID NO: 171318 - DNA, 912 bp, Homo sapiens
  misc_feature: GYAE6OF01CPREF.27.78.H01.1.454.CMB.1.raw
tcagagcgtcgtctcacgaccggtgctcgatttagtgtgagtagtttgggtttggggatcttaaaagaggttctttctctgggatggggcatgagacaaaaacctaagacaaagtaacgaacggacgaaggaaaggtaatgttcggtccactacaaccaaactacctagtttcgggttttcgttgtctcgtctccggttcgggttacccgtaccgccgtcccggtaagggggttaaggtaaaagtttgttgcgtacgtactacgtacgtcctcctaacgtaacctttctacgtcttgtacgacctaaaccgaaagggaaaggtaaactaccaccaacctacctaacccggtccgggacccgggaccgtacgtacgacggtaacggtcggtttagggttaacgttaacgtaccttaaccgtaccgtaggtaaccgacgacgaaacggaacgaccggtacggtaccacgtacccgtaaccgaaaacgtcctaccctacacttaaacgtaagttacgtaccttaccccgttccttaaccgttcccgttacgtacccgggttaccccgggggtaccccttacggtcggtttaacgcgggtacgtcggtaagtcgggtcttacgggtacgaaccgtaacctttaccgtaccctacccgtactaccctaagtaacgtaaccgtacggtacgtaacgggaacgtacggtaaacgtagtacgtaccgtacgtaacgttacctaaattttaccgtttacgtaccttagaacgttaaacgtacggttaaacctttaaacctttaaccctttaccggaaacttcggttaacgtaaccttccccggttaaccggtaccggaaccggtaaacggaccgttaaaccggacggttaacggtaaacgtaaacggttaaacgtaacggg

SEQ ID NO: 171319 - DNA, 635 bp, Homo sapiens
  misc_feature: GYAE6OF01AGTWI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagactttcagtctgtgactccaaaggagaaagtcacatcacctgccggcagtcagagcgttggagtagcttacactggtaccagcagaagccaggtcagtctccaaagcctcctcatcaagtatgccttccacgtccttctcgacgggttcccctcgaggttcacgtcggcagtaggatcgtaggggaccactagtttaccacccctcgaaccctaatacctaaactacgacccttaggaaacgccgttagaagtacgtacgccgtacggaccttaaacgtttactttacgtcggttactaacgttaccaacgtaagttaaccttaaccttttaccctactaagttacgtaccgtttacaaccccgtttacgggacccctaaacggggtacctaaccgtaaccgtacgggtaaacgtaacgtttaaaaacccggg

SEQ ID NO: 171320 - DNA, 627 bp, Homo sapiens
  misc_feature: GYAE6OF01D6ZKI.27.78.H01.1.454.CMB.1.raw
  modified_base (362)..(362): a, c, t, g, unknown or other
  misc_feature (362)..(362): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatcacctgccggccagtcagagtcgttggtagtagcttacacgtggtaccagcagaagccaggtcagtctacaaagcctcctcatacaagtactcgccttcccgacgttccttcgtccgacgggtcccctcggagttcagtggacaggtgatcgnggactacactttcaccctcaccatacaactacgccgtaggaacgcgttaaggaagtactcgactagtacttaacttattactacgtacattacgagttaacgttacctttaacgtttacctaacgtaaggttacgtaaccttacccgttaccgttaccgggaccgtaacggacctaacggtaccgtaggtaacgtaaacgttaaaccgggtagtcgggtaggtactaccggtcctaaacctagtttccgttcgttccgttacccg

SEQ ID NO: 171321 - DNA, 697 bp, Homo sapiens
  misc_feature: GYAE6OF01CT5AM.27.78.H01.1.454.CMB.1.raw
  modified_base (132)..(132): a, c, t, g, unknown or other
  misc_feature (132)..(132): n is a, c, g, or t
  modified_base (176)..(176): a, c, t, g, unknown or other
  misc_feature (176)..(176): n is a, c, g, or t
tcagagcgtcgtctcacgaccggtgctcgatttagtgtgagtagtttgggttggggatcttaaaagaggttctttctctgggatgtggcatgagacaaaactgaacaagtcaaggcaggaagatgtgccatnacaactcagtgggttctgctgctcgtggtccagcctcaggggtnaattgtgctgactcagctaccagtacttcaggtctagtcgaactacaaaggtagaaactcaactatccaccgtgccggactagtcagacgtcggtagtagtacgtctacgactacggtaccagacaagaacgtccaaggtacacgtacctaccaaacgtctacctacgtaataccgtaaggttactacggacctttacccaacggttcccttaccgtaccggtaaccggggttcccctaacgggtacggttaccgtaggtacgggtactacgggtacggtaaactccggtacgggtaacctacgtactttaccgaaccctaacgacccgttataactaaaccgtagtacccgtacgggaagtaccgtaggtaaagtcctagtaaccgtgtaaaccttaacgtttacgtacttacgtacacgtacgtagtaacgttacttaaccttacggtacaaggtctaacgtccttaaccggtaccgtaacgaacggtcaaacgtccgtaagacgtaaacggttaaacg

SEQ ID NO: 171322 - DNA, 924 bp, Homo sapiens
  misc_feature: GYAE6OF01D6RCM.27.78.H01.1.454.CMB.1.raw
  modified_base (152)..(152): a, c, t, g, unknown or other
  misc_feature (152)..(152): n is a, c, g, or t
tcagagcgtcgtctcacgaccggtgctcgatttagtgtgagtagtttgggtttgggatcttaaaagaggttctttctctgggatgtggcatgagacaaaactgacaagtcaaggcaggaagatgttgccatcaacaactctattgggtttcngctgctcgtcgggttccacgtcccgtaccgtaagggggttttaaaattggtcgcttacgacttacgtagttccttaccctagttaccttttcgaagttccttaggtacgtaaccgttaaccggaaaagggaacgtaaaacgttaccaacccgtaacttacccgtaaccgttccgggaccccgggtacccaaggtaccgtaaggtacggtaccggtttagggtaacgttacgtaccgtttaacgaacgttacggtaacccaacgacgaacgtaaacgaccgtaaggtcctaacgttaccaacccgtaaaacgtccctacccgttactaacttaaccgaaaggttactaccgtacccgtttacccgtaccgtttaccctttccgtaccgggtacccgggggttacccctacgggtttaacggtttaccgtaaggtccggtaacgtacgggttacgtaacggttccgtaacgggtaactacgttacctttacccgaccccgtacaaccgtaataccgaaagtaccgaccggttaagaactacggtagtaaacgtatacgtaccgttaacgtaaccgtttaacttttaacgtacttacggttaaactaaccgttaaccggttaactaaacgtttttaaccccgttaaccgtttttaaccctacggtaaaggttaccggttaaccttaaccccgttaaccggttacccgggaaaacgtaacccgggtaaaccgacggttaacgtaagggaaacgttaaaacgttaaaccgggtaccg

SEQ ID NO: 171323 - DNA, 715 bp, Homo sapiens
  misc_feature: GYAE6OF01CV6BP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccaaaggagaaagtcaccatccaccgtcggcccgggccagtccagtacgtcgttggtagtagtcttacacgtacggtaccagacaagacgccgaggtctagtctaccaaagcctacctacatacaagtatcgtccttacccacgttcccttcgtccggtaccgggttccccttcggtacggttacgtaggtcggactaggttcgagttcggtacggactacgttaccttcctaacccctacgacctatactaactacgcgtaaggaacgtcgtagaagtacgtcgtacgtacgtaacttactttaacgttacttacgtacgtaacttacgtaaggttaaccctttaccgtttaacccttttaccgtaacttaacggttactaccgttacccgtacccggtttacccgggaccgtaaacgggtacccgtaaaccgggtactaacggggaacgtttaaacgtaaaccggtacgttcgggtaccgttacgtacgtaccctaactagttaccttcgttccgtttaacccg

SEQ ID NO: 171324 - DNA, 770 bp, Homo sapiens
  misc_feature: GYAE6OF01BI6U2.27.78.H01.1.454.CMB.1.raw
  modified_base (181)..(181): a, c, t, g, unknown or other
  misc_feature (181)..(181): n is a, c, g, or t
  modified_base (271)..(271): a, c, t, g, unknown or other
  misc_feature (271)..(271): n is a, c, g, or t
tcagagcgtcgtctcacgaccggtgctcgatttagtgtgagtagtttggggtttggggatcttaaaagaggttctttctctgggatgtggcatgagcaaaactgacaagtcaaggcaggaagatgttgccatcacaactcattgggtttctgctgctctgggttccagcctccgaggggtntaaattgtgctgactcagttctccagtactttcagtctgtcacctaccgaaaggagaaacgtccacctatcaccgtggccggcagtcagngtcgttaggtagtacgtacttacacgttcggacagacgaagacgccgtaggtcacgtcctacgaacgtcctacctatactacgtaacgttactcgtaccctttacccgtacgtttccccgtttaccgtaccgggttaaccccggggtccccttacgggtacggtttccgtaagggtccggacgttaggtaccgtacgttacgggacgggtactaaccgttacctttaccccgtaccctacgtaacctacgttaacgtaaacgtaccggttaccggttaaggaactacggttaggtaaacgttcgacgttaccgttaacgtaaccgtttaaaccttttacgttacccgttagttaccgttaactacgtaacgtttaaacccgttactttaaaccctttaaccgaacgttacggtaacttaccgttacccgttacccggtaccggtaaacccggagtacccggtaacgaacggttaacggtaaactaaacggttaaaccgg

SEQ ID NO: 171325 - DNA, 706 bp, Homo sapiens
  misc_feature: GYAE6OF01BNWSR.27.78.H01.1.454.CMB.1.raw
  modified_base (184)..(184): a, c, t, g, unknown or other
  misc_feature (184)..(184): n is a, c, g, or t
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
  modified_base (536)..(536): a, c, t, g, unknown or other
  misc_feature (536)..(536): n is a, c, g, or t
  modified_base (572)..(572): a, c, t, g, unknown or other
  misc_feature (572)..(572): n is a, c, g, or t
  modified_base (690)..(690): a, c, t, g, unknown or other
  misc_feature (690)..(690): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggttctgctgctctgggtcacgcctcgaggggtataagttgtgctgactctacgtctcagtactttcgngtctgtacgactacgaaaggacgaaacgtccaactactaccaccgtcggaccggtaccagtccaaggtcgttacggttggtaagtacgtacttaacgtacggttacggaccagacgaaggaacggccgtaggtacctacgtaccgtaacaactcctactactaactacggtaacttntcccgtcctcccgttactccgttacgtaccggtcccgggttaccctagggttacgttacgtacggtcggacgtaggtacgtacgtcggtacggtaaccnccgtttactccctaacctacctactaacttaacgaacgtaaccgggctaacgggtaacggcttaaggaaacggttntccgggtaactaaacgttaacttaactttaccggtntacgtactacgtaactacgtttaacgtttaacctcgttaaactcgaacgttcaccttacggaacgtacgaacgaaggactcgaacggtagaacttaacgacggtagctagtcgtaacnctaagtcttgtctacc

SEQ ID NO: 171326 - DNA, 838 bp, Homo sapiens
  misc_feature: GYAE6OF01DRVPY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggtttctgctgctctgggttccagccctcgaggggtagaaattgtgctgactcacgtcctccagtaccttttcgagttcgtgttacgtaccttaacccgaaaaggggtaacgaaaacgtaccaacccactcccgtaacccgtcgggccccggggcccgtaaggtccgaaggtaggtccgggtttagggttaacggttaacggtacctttaaccgaaccggtttacgggtaacccaggacgaacggaaacgggtaccccgtaggggttacctacggttaccctaacccgtaaaaccgtcccttacccttacgtaacttaccgtaaagttaccgtccgttaccctttaccccgtacggtttccccttcccgtacccgggtacccggggttcccccgttacggtacgggtttccgaagggttcgggacgtaacggttcggtacggtaccgttaggggaaccttaaccttaccgtttacccctaccccttaccgtaaccctactaacaaacgttacggaccgtaggaacgtacgaagtaagtacgtcgacgtacgtaccttaactttacgttacgtagtccgtatacgtagttaaccgttaccttaacctttacctacgtaacgtactaccgtaccttacccgttaccggacccgtaaacggacgtaacggtagtaacggtaacgtaacgtaaaccgg

SEQ ID NO: 171327 - DNA, 606 bp, Homo sapiens
  misc_feature: GYAE6OF01BVPGH.27.78.H01.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (460)..(460): a, c, t, g, unknown or other
  misc_feature (460)..(460): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattggttctgctgctctgggttccagcctcgaggggtnaattgtgctgactnacgtctccagtactttcagtcngtcactacaaaganaagtcacctatcacgngccggctagcagngtcgtgtagtgtcttacacgttggaccagacgtagaacgcgacggttcagttaccacaanccttaccacatcaagtactgtcctccacgttctcgtcgacgggtcctcggagttccaggtcganagtcgatcgacggactagtaacttcacctcaacgtactaactaagtacgaccgtagacgacgtagaagtcgtagtccgtanccttaaacttacttacgtcgtaacctgtaccgtagtaccgttaaacgttaccttaccgtaaccgtacgttacgtaacccgtaccttacccggtacggtaaccgacggtaaccgaccgaaacgtttacggaaacgtacgtaaaaccg

SEQ ID NO: 171328 - DNA, 646 bp, Homo sapiens
  misc_feature: GYAE6OF01AGLEH.27.78.H01.1.454.CMB.1.raw
  modified_base (146)..(146): a, c, t, g, unknown or other
  misc_feature (146)..(146): n is a, c, g, or t
  modified_base (359)..(359): a, c, t, g, unknown or other
  misc_feature (359)..(359): n is a, c, g, or t
  modified_base (408)..(408): a, c, t, g, unknown or other
  misc_feature (408)..(408): n is a, c, g, or t
  modified_base (610)..(610): a, c, t, g, unknown or other
  misc_feature (610)..(610): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgaggggtnaaattgtgctgactcagtctccagactttcagtctgtgactccaaaggagaaagtccaccatcaccgtgccgggccagtcagagtcggttggtagtagcttaacacgtcggtaaccagcagaacgccgaggtcagtctccaaagctcctcatcaagtatgtcttccagtccttctcgacgggtccctcgtacggttcaggtgcgagtgatcgnggacacgtattccaccctcacctaatacaactacgaccgtagggtaacncgtagtaagacgtacgacttcggaaccttaaacgtttacttaacgtacgttactaacgtcgtaaacgtaacggtttaacccttaacttttaacccgttaacgtaaacggttacggtaactacccgttaacccgtttaccggaaccggtaaacggggtaacaccgggtaacgtagggaacgtaaacgttaaacgtacgttggnggtacctggtaccacgtactacgttcgtccttaccg

SEQ ID NO: 171329 - DNA, 739 bp, Homo sapiens
  misc_feature: GYAE6OF01B9OL3.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttggggtttggggatgagcaaaactgacaagtcaaggcaggaagatgttgccatcacaactcattgggtttctgctgctcgtgggttcagcctcgaggggtntaaattgtgctgactcagtctcagtactttcagtctgtgactacgaaaggacgaaagtcaaccatccaccgtcggccgggtcagtcagtagtcggttaggtaggtactcgttacacgtcggtaaccagcgaagaacgcagtacacggttctacaacgtctacctacataacgaagtactcgtccttacctacgttcctttacgccggtaccgggtcccctggttacggttacgaggttggaccgtagggttacgacgttcggacggtaccacgttaccgttacctacccgtctaacgtactaacgtaacgtacgtaccgttaggaacgtacgtaggtaacagtcggtactacgttaacttaacgttacttacgtaggttactaacgtcgttaacggtaaccttttacctttaaccgttaacctttaacgacgtttaacgtacccgttaaccgtacccggttaacgggacccgttaaacgggaaccgtaaacggtaacggtaagggtaacgtaaaacggttaacccgttaaggttacggttacgtacggtaccctaacggtacttagggttacccttggttacctttaccccg

SEQ ID NO: 171330 - DNA, 841 bp, Homo sapiens
  misc_feature: GYAE6OF01EW6LB.27.78.H01.1.454.CMB.1.raw
  modified_base (170)..(170): a, c, t, g, unknown or other
  misc_feature (170)..(170): n is a, c, g, or t
  modified_base (748)..(748): a, c, t, g, unknown or other
  misc_feature (748)..(748): n is a, c, g, or t
tcagagcgtcgtctcacgaccggtgctcgatttagtgtgagtagtttgggttgggggcatgagcaaaactgacaagtcaaggcaggaagatgttgccatcacaactcagttcggtttctgctgctcgtgggttccagcctcgaggggtataattgtgctgactcacgtcncctagtactttcagtctggtacacgaaccgtaaagaacgtaaacgtccaacctactacccgacccggtccggaccgggacctagtaccgtaaggtcggttaccggttaggtaacgttacgtaccttaaccgtacgtaccgaccacgtacgaaacggacgaccgtaggtaccacgttaccctaaccgtaacgtcccttaccgtactaacttacggtaaaacttcgtccggttcccctttacccctaccttttcccggtttccggtaccggtaccccggggtttccccttacggggttaacggttaccggtggttaccgggtaacggtcggttacggttaccgaaccggtagggttaaccctaacccgtttacccgtacccgtaccctaaccctaacgttacttaaactaaccgggtacgtaaccgtacggtaacgtacggtacgaaagttccgacgttcgaaactttacggtttaacttacctttacggactacgtactaacgttaacggttacctaaccttttacgtaacctacggttaactcgtttaaaccctcccggttaaccgaccgggttaaancccggtaacgtaccggtaaagtaccggtaaacgtaagttaacggttgactcggtacgtaccaacgttacgttcccttagtccgttttaacccg

SEQ ID NO: 171331 - DNA, 724 bp, Homo sapiens
  misc_feature: GYAE6OF01CIXLO.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggggcatgagacaaaactgacaagtcaaggcaggaagatgttgccatcacaactcattggttctgctgctctgggtccagcctcgagggtnaattgtgctgactcagtctccagtactttcagtctgtgacctaccgaaaaggagaaacgtccacctaatccaccgtggcccgggaccaggtccaaggacggtcggtttaggtaagtacgtccttacacggtcggtaccagacgaagaacgccgtaggtacctacgtacctaaccgaaacgtcctacctacaatacctaaagttactacgtaccctttacccagtttcccttaccgttaccggtaccggggttaccccctacggtacggttcgacggttcggactaggtcggtacgtccggtaggactacgtacctttaccgccctaccaactactactaacgtacgaccgtacggaagtacgtacgtaagtacgtcgtacgtacgtacttaacgttacttaacgtcgtactagttactaacgtaccgttaaccttaacccttaaccgttacgtaagtcgtacgttacccgtacgttaccggaaccgaacgggtaccgaaccggtaagtacgggtaaacgtaacggttaaaccgtcgtacggtaccgtacgtactactaccgtacttcgtcggtttacc

SEQ ID NO: 171332 - DNA, 796 bp, Homo sapiens
  misc_feature: GYAE6OF01CJOVY.27.78.H01.1.454.CMB.1.raw
  modified_base (149)..(149): a, c, t, g, unknown or other
  misc_feature (149)..(149): n is a, c, g, or t
  modified_base (347)..(347): a, c, t, g, unknown or other
  misc_feature (347)..(347): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctcaatctttcagtctgtcgacacgaaaggagaaagtcaccatccgaccgtcggcccgggctacgtacgaggtacggtcggttggttaagtacgtacttaacgacgttacgtaaccgacgacgaaggaacgaccgacgggtcaacgtcctaaccaaacgccttctacactactaacgttntccgtccttaccgtcttcccgttcctaccgggtcccgggtccccttaggtacggtttccgaagggttccggagtaaccggtgggtacgtacggtaccgggaactaactacctttacccgaacccctacgtaaccacttaaccaacgtaacgggtccgttaggaaccgtcgtaaggtactacgtcgacttacggtaactttaacgtttaactttacggtacctaaacgtcttaaaccgaacggttaacctttaacctttactttaaacccgtcggtaaaacgttttcgaaccttttaaccccggtaacggttaccgggaacccgggaaacgggtaccgtaaccgttaaacccgggtagggtaaaccgtttaaaacgttaaccgggttaacgtcgggttaacccgaactttaacggaccgaaaccctttggttaacccgttccggttaccc

SEQ ID NO: 171333 - DNA, 719 bp, Homo sapiens
  misc_feature: GYAE6OF01A7DQV.27.78.H01.1.454.CMB.1.raw
  modified_base (144)..(144): a, c, t, g, unknown or other
  misc_feature (144)..(144): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctggttccagcctccgagggtnaaattgtgctgactcagtctccagtactttcagtctgtagactaccgaaaggagaaacgtccaccatccaccgtggccgggccagtcagagtcgttggtagtacgtcttacacgtcggtaccagcagaacgccgaggtactacgtcctaccgaaacgtcctacctctaactaccgtaaagttactcgtccttaccctacgtttcccttccgtccggtacccgggtcccccgttagggtacggttacgtaggtcggtacgtaggtacggtacgtccggtacgggtaaccctaacgttacctttacccaacccctacctaacccgttaactaacccgtaaacgttacccggtaccggtagggaaccgtacgtacggaacgtacgtacgtacctacgtaaccttaacgtttactacgttcgtactacgtacgttaacgtacgtttaaccttaacctttaacctacgtacgtattaccctaccgttaccgttaccggacgaacggtcaacggtagtacggaacgtaacgttaacgagttcggtacgtcacgtacctaccgtattccgttctcgttaccc

SEQ ID NO: 171334 - DNA, 876 bp, Homo sapiens
  misc_feature: GYAE6OF01CI9UL.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggttctgctgctctgggttccagcctccgaggggtgaaattgtgctgactcagtctccagtactttcagtctgtcgactacgaaaggagaacgtcaccatcaccgtcggccggccagtccgaggagtcggttggtagtacgtaccttacgtacgttacggtaaccaggacgaaggaacgaccgtacggtaccgtacgttacctaacccgaaactccctacctccactacgtaagttcgtacgtcccttcccgtaccgtttcccttaccgtccgggtacccggggtttcccccgttacgggttacggtttacccggagggttcggtaccggtacgggttacggggtaccgttacgggtacggggtaaacccctaacggtttaaccccttttaccccgtaaaccccctacccgtaaacccgtaacttaacctaaacgttacccgggtaaccccgttaagggaaaccgttacgtaacgggtaaatcggttacgttcgtaaccggttacctttaaacctttacttaaccggttacttaacctaacgtttaccggaacgttttaaaccgtttaaccgttttaacccttttaaccgacggtttaaacgttgtaaccttacccggttaacccggttacccggtaaccgggaaacggtaccgtaccggtaacggttaacgggaagttttaaaaccccgggaaaggtttaccggttacgggtactccggtaaccctacccgttaactacggtttcccgttcgtttaacccg

SEQ ID NO: 171335 - DNA, 592 bp, Homo sapiens
  misc_feature: GYAE6OF01BBRIA.27.78.H01.1.454.CMB.1.raw
  modified_base (169)..(169): a, c, t, g, unknown or other
  misc_feature (169)..(169): n is a, c, g, or t
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
  modified_base (576)..(576): a, c, t, g, unknown or other
  misc_feature (576)..(576): n is a, c, g, or t
tcagagcgtcgtctcacgaccggtgctcgatttagtgtgagtagtttgggtttgggggcagtgagcaaaactgacaagtcaaggcaggaagatgttgccatcacaactcattgggtttctgctgctctgggttccagcctccaggggtgaaattgtgctgactcagtcnccagactttcagtctgtgacctccaaaggagaaagtcaccatcacctgccggccagtcagagcgttggtagtagcttacgactgtaccagcagaagccaggtcagtctcaaagctcctcatcaagtatgcttccagtccttctcgacgggtcccctgacggttcagtgcngtggatctagggacactattccaccctacaccctatcaactacgcctaggacnctagaagtatgcgtacgactaacgttaattacgtcgtctatctaacgtaacgttacttaaccgtttacctacgtaaagtcgtaactacccgtaaccgtttcggaacccgtaaggtaacccgaccgtacggtaacggtacgtaaacgttaaaccggtacgtacggtcgaacgtcgaccctaaccngttcccttcgttaccg

SEQ ID NO: 171336 - DNA, 714 bp, Homo sapiens
  misc_feature: GYAE6OF01EMEOD.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgtaaattgtgctgactcagtctcagtactttcagtctgtacgactaccgaaaggagaagtcaccactccgaccgtcggccggccacgtacgagtacgtcggttaggtagtacgtaccttacacgtcggtaccagacgaacgacgaccgtacgtactacgtacctaccgaacgtcctacctactactacgtaacgtacgtccgtccgttaccgtaccgttccgttaccggtaccggtacccggttcccgtacggtacggttacgtacggtcggacgtacggtcgtacgtacggtacgtacctaccgttacttaccctacctacctacgtacgtaacgtaacgtacgtacgtacggtacgtacgtaagtacgtcgtacgtacgtaacgtaaccttaacttacttacgtactacgtaacgtacgttaacgttaaccttaccttacgttaaccgtaacgtacgtacgtaccgttaccgtaccggtacgacggtaacgtacgtacgtacggtaagtaacgtaacgtaacgtacgtcgacgtcgtacctaccgtacttacgtcttcgtcgtacc

SEQ ID NO: 171337 - DNA, 810 bp, Homo sapiens
  misc_feature: GYAE6OF01CUAEB.27.78.H01.1.454.CMB.1.raw
  modified_base (187)..(187): a, c, t, g, unknown or other
  misc_feature (187)..(187): n is a, c, g, or t
tcagagcgtcgtctcacgaccggtgctcgatttagtgtgagtagtttgggtttggggatcttaaaaagaggttctttctctgggatgtggcatgagacaaaactgacaagtcaaggcaggaagatgttgccatcacaactcattgggtttctgctgctctggttccagcctcgaggggtagaattgngctgactcgagtcctccagtactttcagtctgtacgacctaccgaaaggagaacgtacaccataccaccgtcggccgggtaccagtaccgagacggtcggttaggtagtacgtacttacacgtacggtaccaggacaagaacgccgagctacggtaccaccaacgtcctcctactactacgtaagtactccgtccttaccccgtacgtttccccgttaccggtaccgggtacccgggttacccctacgggtacggttcgtaacggtccgggacgtagggtcggtaccgtacggtacggaacccttaccgttaccgttaccccaacccgtaccctaaccgtaacgtaaccgtaaacggttccggaaccggttaacgggaaccgtacggtaaagtaacggtacgttcgtaaccggttaacttaaaccctttaacggtttactttacgtaacgtaaccttaagttaaccggtaagttaacccttttaacccgttttacccgtaaccgttacggtaaaggtcccttaacgtttacccccggttaacccgggttaacccgggaaacccggtaacgggtaaaccctacgggttacgggtaaaggtaaacccgtaacgtttaaacccggg

SEQ ID NO: 171338 - DNA, 764 bp, Homo sapiens
  misc_feature: GYAE6OF01CT2NP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccgagggtagaaattgtgctgactcagtcctcagtactttcagtctgtgactaccgaaaggagaaacgtcaccactccacgtcgccggctagtcgagcgtacgttaggtagtacgtcttaacacgtcggtaacagacgaagaacgccaggtacacgtacctaccgaaacgtcctcctacaacgtacgaagttactcgtaccttcccgtacgtttacccttacgtacccggtacccgggtacccccgttacggtacggtttaccgtaggtacggacgtaaggttacggacgttccggtaagggtacctactttaaccgttaccctaaccctaccctacctaaacttacaaacgttaaccgtaccgttaagggaaacctcgtaacggtaacgtacgtagtaccgttaaggtaacccttaaacgttttacttaacgttacgttactaacgtttaacgtaacgtaaaccgtttaaccttttaacccgtttaaccgttaactaacggttaacgtacccttaccgttacccgtaccggtacgaaccggtaacgaaaccgtatacgggttaaactaaacgttaaacgaccggttaagcggtacacgtactaactcgttactcgtttcgttaaccc

SEQ ID NO: 171339 - DNA, 711 bp, Homo sapiens
  misc_feature: GYAE6OF01EK0DM.27.78.H01.1.454.CMB.1.raw
  modified_base (146)..(146): a, c, t, g, unknown or other
  misc_feature (146)..(146): n is a, c, g, or t
  modified_base (555)..(555): a, c, t, g, unknown or other
  misc_feature (555)..(555): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcgaggggtnaattgtgctgactcagtcctccagtactttcagttcctgtagacctaccgaaaggagtaaacgtccaacctactccaccgtcggccgggccagtcgaggacgtcggttaggtacgtagtccttacacgtcggtaccagacgaacggaacgccgaagggtccacgttcctaaccgaaacgtcctacctacgaactacgtaaagttctaccgtccttacccgtacgttcccgtttaccgtaccggtacccgggttcccctacggtacggttaccgtaggttcggcgtaaggtcggtacgtcggtacggaacctacgttcctttacccacctaccgacctatactaacgtacgtcgtacgggtactacgtagaagtctcgactacgtactaacgtttacttacgtcgtactntacgtaacgttaaccttacgttaacctttacctaacgttacggtacttacgtacccgtacgtacccggaacggtaacgacgtaccgagttacggaacgttaaacgtacgtacgttgaccgtccgtacgtaccctagtccttcgttcgtcttacccg

SEQ ID NO: 171340 - DNA, 694 bp, Homo sapiens
  misc_feature: GYAE6OF01BE93B.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtcctgtgactaccaaaggagaaacgtcaacctatccacctcggcccgggtccaagtcagtaggtcgttaggtagtagtcttacacgtggtaccagccagaacgccaggtcacggtcttaccaaaagcctacccgtacactacgtaagttactcgtacccttacccgtaccttcccttacgtaccgggtacccgggtcccccgttacgggtacgtacgtacggtccggtacgtacggtaggtactccggttacgggacctacgtttacttcccgaccttaccctaaccgtaactaaccgtaacgtaccggtacggtaacgggtacgtacgtaggtaacgtacgtcgtacgacgttaacttaacgttacgttactacgtactacgtacacggttaacctaaccgtttaccgtaactacgtacgtctaacctccgttccgtaacggacgtaacgtacgacgtacgtagacgtaacgtaaccgagtcgactagacctaccacgtacctgtcttccctacg

SEQ ID NO: 171341 - DNA, 782 bp, Homo sapiens
  misc_feature: GYAE6OF01CPQBD.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagtaaattgtgctgactcagtctccagtactttcagtctgtgacctacgaaaggagaagtcaccatcacctcggccggcagtcagtgtcggttaggtagtacgtacttacgacgtacggtaccagacgaagaacggaccgaggtactacgtaccgtaaccgaaacgtcctacctactaacgttacgtaaacgtactccgtaccctttacccgtaccgtttccgtttcccgtaccgggtacccggggttccccctacggttacgggttacgaacgggttcggcgtacggttaggtacgttcgtacgggtaacctaacgttacctttaccctaaccccgtacaaccgtacctaacgtaaagtaccgtacccgtaagggaacgtacgtacgaagtacgtcgtacgtacgtaaccttaaacgtttactttacgtgtacgtacgttaacgtaaacgtaacgtttaaccctttaaccgtttactaacgtagttacgtaccttaaccgtaccgtttacccggaccgaaccgggtacaccggtaaacggttaacgggaaagtaaaccggttaaacggtaaccgttggtacccgggtacttaaccggtacccgtacttacttccggttacgttcccgttacccg

SEQ ID NO: 171342 - DNA, 915 bp, Homo sapiens
  misc_feature: GYAE6OF01BW8WA.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccgaggggtnaattgtgctgactcagtctccagactttcagtctgtcgactaccaaaggagaaacgtccacctatccaccgtcggccgggccagtacgagacgtcggtttggtagtacgtccttacgacgttacggtaccaggtaccgaaggaacgaccgtaagggtcctaacggttacctaacccgaaaagtccctacccgtactaactaccgtaaaggttacttaccggtccctttacccccggaacgtttttcccccgttcccgtttacccggggttaaaccccggggggtttcccccccgtttaacgggtttaaccggggttttaccgtacgggggttaaccggggtccgttaaagggggtttacgggaacgttttcccggggtaacggggtaaaccccttaaacgttttaaccgttttccccgaacccccttaccgaacccttaaactaaccgtaacgttacgtacccgttagggaaccgtacgtaggtaaaacgtcgttacggtacgtaacgggtaccttaacgttttaacgtttacccgtcgtttaactaccgttacgtaacggttaaccgtttaaccctttaaccgtttacccgttaaccgtaaggttaccttacttaccccgttacccggtaccggttaacccggaaaccgggtaccctaacgggttaacccggtaagggttaaaccgtaaacccggttaaacggttacccgggttacgttcggaccttaacggtaccaaccctttcgttaccgttcggtttaacccc

SEQ ID NO: 171343 - DNA, 725 bp, Homo sapiens
  misc_feature: GYAE6OF01EP35L.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctggttccagcctcagggtgaaattgtgctgactcagtctaccagactttcagtctgtgactcaaagganaagtcaccatcacctgcccgggccagtcagagtcgttggtagtagtcttacacgttcggaccagcaagaacgccagggtcagtcctaccaaacgtctacctcatcaagttactcggtcttccccgagttacccttctaccgtacggttttccccaggtacggtttcacgttggctaggtacggtactccggtggggaacctacgtacgtttacccaccccgtacgtaccctaactacctaaacgttaccggtaccgtaacgggtaaaccggtacgtaacggaaacggtacgtacgtaccgttacggtaaccttaaccgttttaactttacgttaccgtaccgttaaccttaaccggtaacgtacgtttaaccttaacccttttaaccctacgtaacgttacgtaacgttacctacccgttacccggaaccgtaacggaaccctacggtaaccgtacgggtaacgtaaacgttaaaccggtcgttacggtcgttaccgtacgacgtacctacgttccgtcgtttaacccg

SEQ ID NO: 171344 - DNA, 745 bp, Homo sapiens
  misc_feature: GYAE6OF01CF7WH.27.78.H01.1.454.CMB.1.raw
tcagagcgtcgtctcacgaccggtgctcgatttagtgtgagtagtttgggtttggggagtcttaaaaagaggttctttctctgggatgtggcatgagcaaaactgacaagtcaaggcaggaagatgttgccatcacaactcattgggtttactgctgtctctgggttccacgcctccgaggggtacgtaaagttgtgctgactcgacgtctccagtactttcgagtcgtgtcgaacctaccgaaaggtaagtaacgtaccaacctactaccaccgtcgcccgggaccacgtaccgagacgtcggttggtagtagtccttaacgactacggtaccagtacgaacgagaccgaggtcacgtcctaccgaagtcctcctagactacgtaagtactcgtcctaccgtacgttccgttaccgtccggtaccggggtcccctcggtacggttacgtaggtcggcgtaacggtcggtacgttcggtacgggaccttaaccgttacggtttccccgacccctagaaaccctacttaccgaaagttacgtcccgtaaggaacgtctaaggaaggtattacgacgttacgaacctttaacgttttacgtaaccgtttcgaacctaacgtcgtaaccggttaacttaaccctttaccgtttaaccaacgtaggttacgacgttaacccgtcgggttaacccgaaccggttaacgaaccgttcgtaaagtcggtaaacgtttaactaaaacccgggg

SEQ ID NO: 171345 - DNA, 820 bp, Homo sapiens
  misc_feature: GYAE6OF01CTA72.27.78.H01.1.454.CMB.1.raw
  modified_base (144)..(144): a, c, t, g, unknown or other
  misc_feature (144)..(144): n is a, c, g, or t
  modified_base (791)..(791): a, c, t, g, unknown or other
  misc_feature (791)..(791): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggtcagcctcgagggtnaattgtgctgactcagtctcagtactttcagtctgtgactaccgaaaggagaaacgtcaccatcaccgtcggccgggaccagtacgaggtgtacggttaggtagtacgtaccttacgacgttacggtacagcgaagaacggccgaggtcaacgtacctaccgaaacgtcctacctaccaataccgtaaagttacgtcctccttacccgtacgtttcccgtttaccggtaccggttacccggggttccccttacgggtacggttaccgtagggtacggtaccgtagggttacggtacctttcgggtaacggtaactacctttaccgttaccctaaccctcctaaaccaacgttaccaaacgtacccggtaccgtaaggtaaccgtacgttaagaaacgtcgtaacgtccgtaactaaaccgttactttaaccgtagttttaacgccgttaagtaaccgtacggttaaccgtttaaccctttaaccggtttaaccctaaggttaaaccgttacgtaacccttaccggttaaccccgggttaccggaacccggtaaacgggaacccgttaaccggtaacgggttaaacggtaaccggttaaaacggttaaaccgttaacgggtacgttccggtactaccgtacgttaacnccgttttaacgtccttaaccgtttacccg

SEQ ID NO: 171346 - DNA, 572 bp, Homo sapiens
  misc_feature: GYAE6OF01ETV35.27.78.H01.1.454.CMB.1.raw
  modified_base (555)..(555): a, c, t, g, unknown or other
  misc_feature (555)..(555): n is a, c, g, or t
tcagagcgtcgtctcacgaccggtgctcgatttagtgtgagtagtttgggtttggggcgcatgagcaaaactgacaagtcaaggcaggaagatgttgccatcacaactcattgggtttctgctgctctgggttccagcctcaggggtgaaattgtgctgactcagtctccagactttcagtctgtgactccaaaggagaaagtcaccatcacctgccggccagtcagagcgttggtagtagcttacacgtggtaccagcagaagccgaggtcagtctaccaaagcctcctcatacaagtatcgtcctttcccagtcccttctcgtacgggtcccctggtacggttcagtcggctagtggtatcgtcgggactacgtactttccaccctcaccatactaatacgccgtaggaagctagaagtactgcgtacgactaacttacttacgtcgtcaagtacagtacgttaccttaacgtttaccatagttactactctaccgtccgtaccgaaggtaccaacgacgtcggaataacgtaaacgacgttagtcggacttnaccgtactctgttaccg

SEQ ID NO: 171347 - DNA, 1005 bp, Homo sapiens
  misc_feature: GYAE6OF01CFNTT.27.78.H01.1.454.CMB.1.raw
  modified_base (123)..(123): a, c, t, g, unknown or other
  misc_feature (123)..(123): n is a, c, g, or t
tcagagcgtcgtctcacgaccggtgctcgatttagtgtgagtagtttgggtttgggggatgagcaaaactgacaagtcaaggcaggaagatgtgccatcaacaactcagttgggtttctgctnctcgtcggttcacgcctaccgagggtagtaagttgtcgctgactcgacgtcctaccacgttacttacgacgttcgtgtacgacctaaccggaaaaggaacgaaacgtccaaccactacccgtaaccgtccgggacccggaccgtacggtacgtaacggtacggtcggtttagggtacgtaacgtaccgttacgtacgtacgtaccgacgacaacggaacgaccgtaggtcctaacgtacctaaccgaacgtccctacctacgtaactacgaagttacgtccggtaccccttacccgttaccttaccccgttttaccggacccgggttaccccgggttaccccgtacggttacgggttaccggtaagggtccggtacggtaggttaccggtaacgttcccggtaacgggtacctttaaccgtttaaccccttttaccccgaaacccgttacccctaaaccgttaaaccgtaaaccgttaaaccgtaacccgggttaaccgggtaaccggggtaaccgtaacgggtaaccgggtaaaggtccggttaacgtacccgggttaaccgttaacccgtttaaaacggtttttacttaaaccgtttccggttaaagtaccgtttaacgtaaccggtttaaaccggttttaacccttttaaaccggtttaacccgtaacgttaaaccggttccgtaacccgttacccgggtttaccccgttaaccgggaaccccgggtaaaacggaccccggttaaacggttaaccggtaaaggggttaaaacccgtttaaaaccgttaaagggtaaccggttacgggttacccggtaaccgacccggttacccaaacgtttacccggtttaaacctttccgggttccctttaacccggg

SEQ ID NO: 171348 - DNA, 730 bp, Homo sapiens
  misc_feature: GYAE6OF01D0QPN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaagtcaccactcaccgtcgccggccagtcagagtcgttggtagtagtcttacgacgtcggtaccagacgaagaacgccgaggtctacgtcctaccgaaacgcctcctactactactaagttcgtcgtccgttcccgacgttcctttcgtaccggtaccgggtcccgttcggtacggttcgaggtcggacgaggtggtacgtcgtacgggtactaccgtacgtttaccctaccgtacctaacctactacgaactacgtaccgtaggtaaacgccttaggaacgtagtacgtcgtacgtaacctaacttttacgtacttacgtactactacgaacggttaactttaaccgtttaactttaacccttacggtaagtaccggttaaccttacccgttaacccgggttacccggaacgtaaaccggggtaacctaaccgggaacgtacgggtaaagtaaaccggttaaaacgtacggttcggtacgggacctttacgacccttaaccgtagttcccgttcgttacctttacccg

SEQ ID NO: 171349 - DNA, 832 bp, Homo sapiens
  misc_feature: GYAE6OF01BL8Z4.27.78.H01.1.454.CMB.1.raw
tcagagcgtcgtctcacgaccggtgctcgatttagtgtgagtagtttgggtttgggatgagacaaaactgacaagtcaaggcaggaagatgttgccatcacaactcagttgggtttctgctgctcgtcggttccacgtcctccgaggggtgtaagttgtgctcgactcgacgtcctaccagtactttacgagttctcgtacgacctaaccgaaaggaacgtaaacgtccaaccacgtaccgaccgtcggcccggactacgtcgaggtacggtcggttaggtacgtacgtacttacgcgtacggaccagacgacgacgccgtacgtacgacgtccaccgaacgtcctcctacaactacgtaagttccgtaccgtcccttacccgtacgtttcccgtacggtaccccggtaccgggttccccgtacgggttacggtacggtacggttcgggtacgtacggtggtaacgttcgaacgggtacccttaccgtttaaccgtttaccacccctactaacctaacgtactaacgtacgtaccgtaaggtactacgtaaggtacgtacgttacgctttaacgttaaccgtttaaacgtttacccgtttacgcttaaaccgttagtacccgttaaagttacccttttaaccgtttaaccttaacccgtaagttaccggtaacctttacccgtaaccggtttaccccggaacggtaacccggaccggtaaacgtaccgggttaacgtaaacgggttattaaaacccgggttaaacgtaacgggtcgtaacggacccgttacctaacgttacggttacttttccggactttacggtaaccccg

SEQ ID NO: 171350 - DNA, 869 bp, Homo sapiens
  misc_feature: GYAE6OF01ALHQ3.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactacaaaggagaagtcaccatcaccgtcgccggcagtcagacgcgttggtagtacgacttacacgtggtaccagacaagacgccaggtcagtacctaccaaacgtcctccctacactacgtaagttacttcgccctttcccgtaacgtttccccgtttaccgtacccgggtacccggggtttacccccgtacgggttaccgggtttcgaacgggttcgggacgtacggttacggggtaacgtttaccggtaccggggtaaacccttaaccttaaccggttttacccctaaaccccccgttaccccaaaacccgttaactaacccggttaaaacggttacccgggtaacccggttaacggggtaaaccgttaccgtaacgggtaaaacggttacgttacggtaaccgttacggtaaacccttttaaacgttttaaccgtttaaccgtttacgtactaacgttaccgtaacgttaactttaaccgtttaaccctttaccgtaacgtaacgttacgtaaccgttaccgttacccgttacccgggaccgtaacgggtaaccgtaacccggtaaggttaaaccgggaaacggtttaaacgttaaaaccgggtaaacggtttccgggtacggttaacccgtaccgtaacccgtaaccgttacgtttacctttcggttcctttaacccgg

SEQ ID NO: 171351 - DNA, 769 bp, Homo sapiens
  misc_feature: GYAE6OF01E5QXU.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccgaggggtgaaattgtgctgactcacgtctccagtactttcagtctgtcgaactaccgaaaggagaaacgtcaccactccaccgtcggccggccagtacgaggtacgtcggttaggtaacgtacgacctttacgacgtacggtaaccaggacaagaacggccgacggtcacgtacctaccaaagtcctacctacactacacgtactcgtcctaccctcgttccgttccgtccgtaccgggttcccctaggtacggttccgaggtcggacgtacggtcggacgtcggtaccggtaactaccttacgttaccctacctaccgtaccaagtaccgaaacgtacgtaccgtaggacgttacgtaagaagtacgtcgtacgttacgtaacgtttaactttagttacctacgttaactactaacgtaacgtttaaccgtttaacccttaacgtttaccgtaacgtaacgttacgttaaccgtccccgttaaacccggttccggaaacccgggtaaaccggtaacccgtaacggttaaacggtaacggtaaaccggttaaaccgttaacggtacggttaccggtacggtaccgtaccgtaaccctaccttacctttccgttacgttccctttaccccgg

SEQ ID NO: 171352 - DNA, 791 bp, Homo sapiens
  misc_feature: GYAE6OF01A7BGR.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttcgccatcacaactctagttgggtttctgcttcgctcgtcgggttccacgtccctcgaggggtgaaacttgtgctgactcacgtctcctacgtacttcgagtctgtgactaccgaaagacgaagtccacactcacgtcggccggctagcgagtacgtcgttggtagtacgtactacgacgttcgtaccgagccgtaagaacggtccgtaggtcctaacgttaccaaccgaacgtcccttcctactactacgtaacgttactcggtacccttaccgtaccgtttcctacgtcccgtaccgggtacccgttacgggtcgttacggtacggtcggtacgtacggttgaacggttccggtaagggtaaccttacggttacccttaccccggtacccgttacgtaaccctaacggttaaaccttaccggtaaccggtaccggttaacggaacccttaggtaacgtaacgtaacgtacgtaccgtagttaaaccttaaccgtttaccgttacgtaacgttaccgtaagtaacggttacgtaaccgttacgtttaaccgttcccgttaataacggggttcctaccggttaacccttacccgggttacccgtaacgggttaaaaccgccggttaaacggtaacccgtacggttaaaccgtaacggttaaaccgg

SEQ ID NO: 171353 - DNA, 744 bp, Homo sapiens
  misc_feature: GYAE6OF01EEZMM.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtcgactaccgaaaggagaaagtcaccactcacctggcccggccagtcagagtcgtttggagtagtccttaacactcggtaccagcaagaacgccgaggtcacgtcctaccaacgtctacctacacgtacaagttactacgtcccttaccccgtacgtttcctttaccgtcccggtaccggggttcccctacgggtacggtttcggacggttacggacgtagggttacggtacgtacgttacggggaacctacttaccgttttacccaccccttacgaaccctactaactaacgtccgtacgtaggaacgtcgttagaacggtagtccgtagtaccgttaacttaacctttacgtttaacgtcgttaactacgtaacgtacgttaaccggtttaacccttttaaaccgttttaccgtaacgttaaggttccgtaacgtttacccttaacccggtttaacccgggaacccgtaaaaccgggtacctaaaccggtacgggttaacggaaacgttaaacccgttaaaacggg

SEQ ID NO: 171354 - DNA, 728 bp, Homo sapiens
  misc_feature: GYAE6OF01DM7MI.27.78.H01.1.454.CMB.1.raw
  modified_base (520)..(520): a, c, t, g, unknown or other
  misc_feature (520)..(520): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccaggggtgaaattgtgctgactcacgtctccagtactttcagtctgtgactccaaaggagaagtcaccatcacgtcgccggcagtcagagtcgttggtagtacgacttacgactacggtaccagacaaggaacgccgaggtcacgtctaccgaaacgcctccactagtacaagtctacgtccttcccgtacgttccgttccgtcgtacgggttccctaccggtaggttcgaggtcggacgtaggtggtaactcggtacgggtaactacgttaccttttacccaccccttaccaaccacttaactaacgtacggtaccgtacgggaaacgtcgtaaggaaacgtagttcgtaccgtacgtaactttaactttactttacgtntacgtaactacgtaagttactttaacctttaacctttaccgtaacgttacgttacgtaacctttcccgtaacccggtttacgggaacccgtaaacgggtaccgtaaaccgggtacgttaacgggtaaaacgtaaacgtttaaaaccggtaacggttacggtacggtaaccctcggaaccacctttaacggtttccgttacgtttaccc

SEQ ID NO: 171355 - DNA, 623 bp, Homo sapiens
  misc_feature: GYAE6OF01D32YS.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaattgtgctgactcagtctccagactttcagtctgtgactaccgaaaggagaaagtcaccatccacctggccggcagtcagagcgttggagtacgcttacacgtggtaccagcagaagccaggtcagtcaccaaagtcctcctacatcgtaagtatcgtccttcccagttccttctccgacggggttcccctcggtaggttcaggtggacaggtcggtatcgtgggacactactttccgaccctcacctatacaacgtcgccgtaggaacgctagaacgtatcgactgaccttaagtttacttacgtcgtacacttacgacgtaacgttaccttaacctttaaccgtagtaacgttagtacttacccgtaaccgttccggaaccgtaacggtaccacggtaacgtaggtaaacgtaacgttaaacggtcgttacggtacgtacctacggtacccaacttactccgttggttaccc

SEQ ID NO: 171356 - DNA, 773 bp, Homo sapiens
  misc_feature: GYAE6OF01C94AG.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctgggttccagcctccgagggtnaaattgtgctgactcagtctccagtactttcagtctgtagactacaaaggagaagtcaaccatccaccgtgccgggcagtcagagtcgttggtagtacgtcttacacgtacggtacagacgaagacgaccgtaggtactagtcctaccgaacgcctctactatacgaagttctcgtccttcccgtacgttccttaccgtccgtaccggggtcccctacggtacggttacgtacggtcggcgtaggtacggtacgttcggtacgggtaacctaccttaccgttaccctaacccctacctaccgtaacttacgtaaacgttacggtacggtacgtaacggtacgttaagggaagtacgtcggtacctacggtaacttaactttaccgtttacgtacgttaccgtaacttaccgttaacggttaacttttaaccctttaacccgtttaacccgttaacgtaacgtttacgttaacccgttacccgttaacccggttaccgggaacccggaaaccgggtaacccgtaaccggtaacggttaaacggtaaacgttaaacggttaaaccgttacggtacgggttacgaccgttaccggaccctacggttacttaccggtcttacccgttaaccg

SEQ ID NO: 171357 - DNA, 726 bp, Homo sapiens
  misc_feature: GYAE6OF01CEA1J.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccaaaggagaaacgtcaccatcacctgccggccagtcgagagtcgttggtagtagcttacacgtacggtaccagcgaagaagccgaggtcagtacctaccaacgctcctcatacgaagtatcgtccttcccgtacgtccttactccgtaccgggtcccctcggtagtcgtagtcggcgtaggtcggtacgttcgtcgggacacgtcctttaccgacccctacacctatacctaacgtacgaccggttaggaacgtactaggaaacgttacgcgtaccgtacgttaaccctttaaacttttaacgtttaaccgttacggtaactaaccgttaccgtaaacgtttaaccgttttaaaccctttaacccttttaacccggttaacgtaaacgtttccgtaaccgttaacccgttaccccggtttaaccgggaacccggttaaacgggacccggtaacggtaacgtaacgggtaactaaacggttaaacgtacggttgtccgtactccggaacctaccgtactttcctccgttcctacccg

SEQ ID NO: 171358 - DNA, 1129 bp, Homo sapiens
  misc_feature: GYAE6OF01DXQ40.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggagtgagcaaaactgacaagtcaaggcaggaagatgttgccagtccacaactcattgggtttctgctgctctggttccagcctccgagggtnaattgtgctgactcagtctccagtactttcagtctgtcgacctaccgaaaggagtaaaacgtctaaccgagtaccgaccgtcggcccgggaccagtcgaggtacggtcggttagggtacgtacgtaccgtttaaccgacgttacggttaacccaaggtaccgtaaacggtaaacggtcccgtaaggggtttaccctaacggttaccttaaacccgaaaacggtcccttaccccggttactaacgttaccctaaacggtttaacgttccggtaccccttttaccccggtaacggtttccccttttaccggtaccccgggttaacccgggggtttacccccccttacggggtaaccggggttttaccggtacgggttaccggggtaccggttaaggggttacgggtaaccgtttccggggtaaccgggggtaaaccttaaaccgggtttaacctttttacccccggaaaccccctttacccggtaaaacccccttaacggtttaaacccgtaaaaaccgggtttaacccgggttaccccgggtttaaacgggggttaaaaccgtaccccgggtttaaaagggtaaaacgggttaacgtttacccgggtaacccgtttaaaccggttaaaccccggtttaaaaccttttttaacccggttttaacccgtttacccgggttaaaaccctttacggtttaaacccggttaaacggttttaaccggtttttaaaccccgtttttaaaccctttttaacccgtaaacgtttaaaacgggttttacgtaaaccccgtttaaacccgtttacccccggttttaaaccggggaaaccccggttaaaaccgggggtaacccttaaaccggggtaaccggttaaagggtaaaccggttaaaaccggttttaaaaccgggaacgtttcgggggtaaccgtaccgtaccggtaaccctaacccgttaagtttcccgtcgtttacccggtttaccc

SEQ ID NO: 171359 - DNA, 561 bp, Homo sapiens
  misc_feature: GYAE6OF01DWIOY.27.78.H01.1.454.CMB.1.raw
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagttctgtgactaccaaaggagaaagtcaccatcacctgccggccagtcagagcgttggtagtagcttacacgtggtaccagcagaagccaggtcagtctcaaagctcctcatcaagtatgcttcccagtccttctcacgggtccctgagttcagtgcngtgatgnggacacacgttcaccctcacatcaatagctagganctgaatagngctagactaacgttattacgtgtacctatacgagtattaccgtactttaacctactaagtcactaccgtacccgttacggcctaaacgggactaaccggacgtacggaagtaacgttaaaaggacgttacggtaggaccttagacccaacctactccttaggttcccttaacccg

SEQ ID NO: 171360 - DNA, 611 bp, Homo sapiens
  misc_feature: GYAE6OF01BGATM.27.78.H01.1.454.CMB.1.raw
  modified_base (313)..(313): a, c, t, g, unknown or other
  misc_feature (313)..(313): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctgccgggccagtcagagtcggttggtagtagcttaacacgtggtaccagcagaagccaggtcagtctaccaaagcctcctcatcaagtatgccttcccngtccttctcgcgggtcccctcgtacggttcgagtcgacgaggtggtagtcgtaggacactactttccacccgtcaccatacaactagcccgtaaggaacgtcgtagaagtagtcgtacgtcgaaccttaactttactttacgtgtactatacgtagtaacttactttaacctttaacctacgtaagtacgtacttacctaccggttacggaacccgaaggaccgaacggtagaaggtaacgtaaagttaaaacgacgttcggtagtaccgcgtaccacgtattccgttcgtcttaccg

SEQ ID NO: 171361 - DNA, 673 bp, Homo sapiens
  misc_feature: GYAE6OF01C4HZB.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctctggtccagcctccgaggggtnaattgtgctgactcagtctcacgtactttcacgtctgtgacctaccgaaaggaacgaaagtccaaccatccaccgtcggaccggccagtacgagagtcggttaggtagtacgacttaacacgtacgtaccagacgaagaacgcaggtcacgtacctaccgaaagccctcctacatacaagtactcgtaccttccacgttccttcgccggaccgggttcccctaggaggttaccagtcggtacgaggtagcgtcggtacggacctactacttaccacctaccacaacttacaataccgcgtaggaactaccgagtaacagtcgactactacgttaactttacgttactacgtactataccgtaacgtacgtttaaccttaaccgttaacgtaacctaaagttccggtaaactcccgttaacccggtttaccggaaaccggttaacggaacccgtaacggtaacgaaacggttaaccgtaaaagtttaaaacccgg

SEQ ID NO: 171362 - DNA, 726 bp, Homo sapiens
  misc_feature: GYAE6OF01D8JDA.27.78.H01.1.454.CMB.1.raw
  modified_base (125)..(125): a, c, t, g, unknown or other
  misc_feature (125)..(125): n is a, c, g, or t
  modified_base (189)..(189): a, c, t, g, unknown or other
  misc_feature (189)..(189): n is a, c, g, or t
  modified_base (291)..(291): a, c, t, g, unknown or other
  misc_feature (291)..(291): n is a, c, g, or t
  modified_base (606)..(606): a, c, t, g, unknown or other
  misc_feature (606)..(606): n is a, c, g, or t
  modified_base (716)..(716): a, c, t, g, unknown or other
  misc_feature (716)..(716): n is a, c, g, or t
tcagagcgtcgtctcacgaccggtgctcgatttagtgtgagtagtttggggtttggggggcatgagacaaaactgacaagtcaaggcaggaagatgttgccatcaacaactctagttgggtttcngctgctcgtgggtccagcctcggaggggtataattgtgctgactcgacgtctaccagtacttcngtctgtcactacgaaggacgaactcacactccgaccgtcggccggactagtacgaggtcggtcggttaggtacgtacgtaccttaacgacgttcggtaaccnggacaaggaacgccgtagtcctacgtaccacgaactcctactacaactcgtaagttcgtcctaccttcccgtacttccgtccgtccggtaccggtaccgtcggttacgttcggaggtcggacgtgtacggagttcggacggtaccttaccgttacttcccgaccctacgtaaccttaacgtactaacggtacggtacgtaacggtacgtaccgaaggtaacgtcgtcggtacttacggtaactttaacggtttcttaccgtatactacggtacttacgttaacgtttaaccttcgttaacgtacgtacgttaacncccgttaacgtacccggtacggaaccggtaacgtaccggtacgaacggttaacggtaaacgttaaccgttaaacggtagttcggtacgacgtaccacggtaacttcgttnttccgttacg

SEQ ID NO: 171363 - DNA, 703 bp, Homo sapiens
  misc_feature: GYAE6OF01B26PC.27.78.H01.1.454.CMB.1.raw
  modified_base (143)..(143): a, c, t, g, unknown or other
  misc_feature (143)..(143): n is a, c, g, or t
  modified_base (696)..(696): a, c, t, g, unknown or other
  misc_feature (696)..(696): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttcagcctcgagggtnaattgtgactgactcagtcctctagtactttcagttctgtgactacgaaggagaactcacatcactcggccgacagtcagtacgtgttagtagtacgtacttacagtacgtacaggacacggacgaccgtaggtacgtacgttacctaaccgaacgtccttacctatactaactaaggttcctccgtccgtttaccctccgttccgttttacgtcccggtacccggggtttccccgtcggttacggttcgacgggtcggtacgtcggtagtcgttacggtacggaactaccgtcttacccaccgtaccctaccgtactaactacgtacgtacggttaacggaacgtacgtagaacgttatcgtacgttagttaactttaactttacggtacttacgtaccagttaccgtaagttaccctttaacttcgttaaccctagttagtcctaacgttccgtaacgtacgaaccggtaatacggtaaccgtagtaaggtaaccgttaaacgttaacgtacgtggaccgtattaccggccttacgtatttcgtaaccgtnttacccg

SEQ ID NO: 171364 - DNA, 780 bp, Homo sapiens
  misc_feature: GYAE6OF01CHO4C.27.78.H01.1.454.CMB.1.raw
  modified_base (151)..(151): a, c, t, g, unknown or other
  misc_feature (151)..(151): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccagcctccaggggtnaaattgtgctgactcagtctccagtactttcagtctgtgactaccaaaggagaagtcaccatacaccgtcggccgggaccagtcgagtacggtcggttggtagtagtccttacacgtcggtaccagacaggaacgccgaggtcacgtcctaccaaagcctcctcaactacgtaagtactcgtaccttcccacgttccttcctcggtaccggggttcccctacggtacggtttcgagggtcggtcgaggtcggtacgttacgtacggggactacctactttaccccaaccctacctaaccctacttaacctaaacgttacgggtacccgtaagggtaaaccggtcgttacgggaaaagtacgttacgaccttaacggaacctttaaaccttttaacgtttaacccgttcgttaactacgttaacgtaacgtaacgttttaaaccctttaaccctttaacccgttacgtaacggttacgtaccttaacccggttccgtttaccgggaaccgtaaacgggaccgaaccggtaacgggtaagggtaaacgttaaaccgttaaaccgggttaacgtacgggttacggaccttaccggaaccctaaccttaccggtttcttcggttttaaccccg

SEQ ID NO: 171365 - DNA, 758 bp, Homo sapiens
  misc_feature: GYAE6OF01BNA3J.27.78.H01.1.454.CMB.1.raw
  modified_base (375)..(375): a, c, t, g, unknown or other
  misc_feature (375)..(375): n is a, c, g, or t
tcagagcgtcgtctcacgaccggtgctcgatttagtgtgagtagtttgggtttggggatcttaaaagaggttctttctctgggatgtggcatgagacaaaactgacaagtcaagggcaggaagatgttgccatcacaactcattgggtttctgctgctctgggttccagcctccgaggggtgtaaattgtgctgactcagtctcctagtactttcgacgtctgtacgacctaccgaaaaggagaaacgtccaacctatccacctcggccgggaccagtacaggtagtcggttaggtacgtacgtccttaacacgttacggtaccagacgaacgaacggccgaggtccgacgtccgtaccgaaacgtcctacctanactactaagttactacgtcccttccgtacgtttccccttacgtcccggtaccggggttcccacggttacgttaccgaaggttcggacgtaggtacggtacttacggtcgggtaacctacgttacttacccgtaccctaccgaaccctaacgtaacctaacgtaccgtacccgtaagggtaactaccgtaaggaactagtacgtacgttcgaaacctttaaccgtttaacgttaccgtacgttactaacgttacgtaacgttaccgttaaccgttttaaacctttaccgtaaaccgttagtaccggtattacccgtaacccgttaccgggaaccgtaacgggtaaccaacggtaacggtaacggtaaacgtaaagttaaaccgg

SEQ ID NO: 171366 - DNA, 786 bp, Homo sapiens
  misc_feature: GYAE6OF01BKQ38.27.78.H01.1.454.CMB.1.raw
  modified_base (189)..(189): a, c, t, g, unknown or other
  misc_feature (189)..(189): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactctagttgggtttctgctgctcgtgggttccagcctcgagggtataattgngctgactcagtcctcagtactttcgagtctggtacgacctacgaaaggagaacgtccaccatccaccgtcggccggacgagtcgaaggacggtcggttggtagtacggtacttaaccgtacgttacgggtaaccagtacgaacggacggaccgtaggtccacgttaccgaccgaaacgtcctccgtatactacgtaaggttactacgtcccttaccgtacgttccttaccgtaccggtacccggttaccccgtacggttacggttacggtacggtcggtacggtaacggttcggtaacgttcggtacgggtaacctaccgttacctttaccccgaaccccttacaaacccgtactaaccgtaaacgtacgtaccggtaacgggtaacgttacgtaggtaacgtctttacgacgttaccgtaactttaaccgttaacggtttccgtacgtttaacccagtaacggttaaccgtaccgttacgtttaacccgttactaaccgttaacggtccgttacgttaaccccgttaaggttaccccgaaacggtaaccggaccgtaaccggttaaggtacggtaaacgtacggttaaaacccggg

SEQ ID NO: 171367 - DNA, 785 bp, Homo sapiens
  misc_feature: GYAE6OF01AZVOG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtacgactaacgaaaggaagtaacgtaccaactactacctaccgtcgggccgggactacgtacgaggacggtcggttaggtagtacgtacttactacgtacgtacacgacaaggaacgaccgtagtacgtacgtcctaaccgaacgtcctacctactactacgtaagtctcgtcccttaccgtacgtttccttcgtaccgggtcccggttcccgtaggttacggttacgagggtacgcggtacggtgtacgtcgggtacggactacgttacgttacccaaccctacctaacgtactaaccgtaaacgtaccggtacggtaacggaacgttacgaacggtaacgttggtaccgtaccgttaacgtaacctttaaaccgttttattaccgggtaattaaccgtaacgttacgaaacgtttactttaaacccgttttacttaccgtaagtaacggttcgttaaccgttacccgttaccgggttaccggaaccgggaacgtaaccgaacgttacgggaaacggtaacgtttaaaacggttaacgacggttacggtacgtactaccggtaaaccttaccggttaatttcggtacctttaccgttacccg

SEQ ID NO: 171368 - DNA, 865 bp, Homo sapiens
  misc_feature: GYAE6OF01EQVEH.27.78.H01.1.454.CMB.1.raw
  modified_base (119)..(119): a, c, t, g, unknown or other
  misc_feature (119)..(119): n is a, c, g, or t
  modified_base (154)..(154): a, c, t, g, unknown or other
  misc_feature (154)..(154): n is a, c, g, or t
tcagagcgtcgtctcacgaccggtgctcgatttagtgtgagtagtttgggtttggggatgagacaaaactgacaagtcaaggcaggaagatgttgccatcacaactcatttgggtttcngctgctcgtgggttccagccgtccgagggggttanaatttgtgctcgactacagtcctccagtactttcgagtctgtacgacctacgaaagggagaaactccaactatccgaccgtcggacccggctacgtacgaaggacggtcggtttagggactacgtcgttactccgtacggtaaccagaccaaggaaccgacccgaggtacctacggtacctaaccaacggtccctacctatactaccgtaagttccgttacctcccgtttacccgtagttcccgttaccgtaccgggttacccggggtacccccgttaggttacgggttacccgtagggtaccgggtacgtaggttacggtaccgttacgggacggtaacccttacctttacccgtttaccccgacccttacgtaaaccttaacgtaaccctaaaggtttaccccgtaacggggttaaccggaaacggttacggttaacgaaaacgggtcctacggtaaccctttaacggtaaccttaaacctttttaacgggtttatccggttacctaacgttaacaaacccggtttttaacctaaccctttttaaacccttcgttaaaacacgggtttataccccgttaccgtaacccggttacggaacggtaacccgtaggaacccgttaaggaaccggttaaactaacgttaacggtaccggttcgtaccgtacgtaccgaaccttacggtacttccgtttaccgagttttaccccc

SEQ ID NO: 171369 - DNA, 778 bp, Homo sapiens
  misc_feature: GYAE6OF01CKA3F.27.78.H01.1.454.CMB.1.raw
  modified_base (205)..(205): a, c, t, g, unknown or other
  misc_feature (205)..(205): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctcgtgggttccagcctcgaggggtgaaattgtgctgactcagtctccagtactttcagtctgtacgactaccgaaaggaanaacgtcaaccatccaccgtggcccggctagtcaggacgtcggttaggtagtacgtacttacgacgttacggtaccaagacaagaacgaccgtacggtctacggtctaccaaacgtcctacctacaattacgtaaagttacgtccgttaccctttccccgtaacgtttcctttaccgttccggttacccgggtttccccgtacggtacggtttacgtacgggtcggtacgtaacggttcgggtacgttaccggtacgggaaccttaacggtaactttaccccgtaaccctacccaaacttaactacgtaacgttaacccggttaccggtaacgggtaaactaccggtaaggtaaacggtacgtacggtaccttaacggtaactttaactttaacgtttaacttcggtactaacttcgtaacgttaacgttacgtttacctttaccgtaacgtacgtacgtacgtacccgtaccgtacggtaaccgaggtacccgtaacgacgtacggtaaacgtaagttaaaccgtacggtaggttcgacgttccggaacttacccgtgttccgtcgtttaccg

SEQ ID NO: 171370 - DNA, 809 bp, Homo sapiens
  misc_feature: GYAE6OF01EG4ZR.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggtccagcctcgaggggtnaattgtgctgactcagtcctcagtactttcgagtctgtacgactaccgaaaggaagaaacgtccaaccatccgaccgtcggcccggcagtcgaggaggtcgttaggtagtacgtaccttacgacgtacgtaaccgagacgaacgaacgaccgacggtacgtacgtacctaccgaaacgtccttaccctacgactacgtaagtacgttaccgtcccttacccgttacgttcccgttccgttaccgggtacccgggttccccgttacggttaacggttcgtaacggtcggacgtacggtcggtactcggtacggactaaccgttacttacccgacctaccactaacgtacctaacgtacgtaccgtaaggtacgtaacgtaggaaggtaccgtagtaccgttacgtaacctttaaacgtttaacgtttaccgttacgttaccgttaacgtaccgttaaacgttaacctttaaccctttaaacgtttaacccgttaacgtaaacggttacccggttaaccttaccccggttaaccggtacccgggtaaccgaaacggtacccgaacggttaaccgtaacggtaaagtaaaccggttaaacggtacggtttaccgcggttaccgaacccggtacctaaccggtttactcccgtttaggttacccc

SEQ ID NO: 171371 - DNA, 544 bp, Homo sapiens
  misc_feature: GYAE6OF01A180I.27.78.H01.1.454.CMB.1.raw
  modified_base (471)..(471): a, c, t, g, unknown or other
  misc_feature (471)..(471): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccgagtactttcagttctgtgactaccgaaaggagaaacgtcaccatccaccgtgccgggccagtcagagtcggttggtagtagcttacacgtggtaccagcagaagccaggtcagtctccaaagcctcctcatcaagtatgccttccatccttctcgacgggtcccctgagttcagtggcagtggatcgtggacactatttccaccctccaccatacaatacgccgtaggaacgtctagaagatcgctagtacctaactttattactgtcagtcaagtacgttaccttaacttacctatagtntactctacctacggaccgaaggacacggactaggaagaacttaaagacgttgcgancgacacntctgtctacg

SEQ ID NO: 171372 - DNA, 706 bp, Homo sapiens
  misc_feature: GYAE6OF01EHEEA.27.78.H01.1.454.CMB.1.raw
  modified_base (147)..(147): a, c, t, g, unknown or other
  misc_feature (147)..(147): n is a, c, g, or t
  modified_base (694)..(694): a, c, t, g, unknown or other
  misc_feature (694)..(694): n is a, c, g, or t
  modified_base (700)..(700): a, c, t, g, unknown or other
  misc_feature (700)..(700): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtctccagtactttcagtctgtagacctaccgaaaggagaaacgtcaaccatccaccgtcggcccgggcctagtcaggtagtcggtttaggtacgagtccttacgacgtcggtaccagcaaggaacgccgtaggtcacgtcctaccgaaagtcctcctacactacgaagttactcgtccttacccgtacgttccttccgtaccggtcccgggttcccccgtagggttacggttcgtacggtcgggtacgtaggtacggtacgttcggtacgggacctacgttaccgtttccccacccttaccgacctactactaaacggtacgtaccgttaggacgtcgttaagggaacgtatccggtactacgtaacgtttaaactttacgttaaccgtctactacgttaacgtaaggtttaaccgtttaccttaaccgttttaccaacgttaacgtcgtaccttccgtaccgtaccggaccgtaacggaccagtacgtaaggtagtaaacgtaagacgttgacgtctacgtactacgtntcgttncgtacc

SEQ ID NO: 171373 - DNA, 809 bp, Homo sapiens
  misc_feature: GYAE6OF01B63HY.27.78.H01.1.454.CMB.1.raw
tcagagcgtcgtctcacgaccggtgctcgatttagtgtgagtagtttgggtttggggatcttaaaaggaggttcttctctgggatgtggcatcgagcaaaactgacaagtcaaggcaggaagactgttcgccatcgacaactcgactttggggtttcctggcctgccttcgtcgggttccaggccctcgacggggttcgtaaagttcgtggccttcgtacgtcaggtcctacctacgtaccttttcacgttcgtcgtcgtacgtaccgaaacggaagtaaacgtcaacctacttcgaccgttacggaccgggtcctaggtcctaggacgtacggttaggtaacggtacgtaccttaccgaacgtacggtacccagacaagacggcctagggtcacgtccactaacggcctcctacgtactacgtacgtacttcgtccttaccgcttcccttacgtccggtaccgggttccccgtacgggtacggtttccgtaggtccggactacggtaccggtacgttccgtaggggtaccctaacgttaccgtttaccgacccttacctaacctacttaccgtaacgtacggaccgttacggaacgtttaccgaacgtaacgtaccgtacgtaccttacggtaaccctttaactttaccgtttaaccgttcgggtaacctacgttacgtaacggttaacctttacccgtttaaccgtttaccgtaacgttaaccgtacggttaccctaacccgtaccggttaccggacccgtaaacgggtacaccggttaccgtacggtaacgttaacgttaaaccgg

SEQ ID NO: 171374 - DNA, 601 bp, Homo sapiens
  misc_feature: GYAE6OF01BCTJF.27.78.H01.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (227)..(227): a, c, t, g, unknown or other
  misc_feature (227)..(227): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctcaggggtnaaattgngctgactcagtcctccagactttcagtctgtgactccaaaggnaaagtcaccatccactcggccggaccagtccagagtcgttggtatcgtccttaacacgtaggtacccagacagaacgtccaggtccacgtctaccaacgcctactcatcaagtntcgcttccngttcctcgtccgacgggtccccagtcggtacgagtggacctagtcggactcggtacggactacgtacttccacccctactaccgaacttcaaattcgaccgttagaacgtcaacggtaagtctacgcttagaaccttaacttagtactgtactacgtacagtaacgttacttacctttaaccacgtaagttacgtccttacgtccgtacgtaaccgaacggtactacgaagtacggtaataacggtaaacg

SEQ ID NO: 171375 - DNA, 766 bp, Homo sapiens
  misc_feature: GYAE6OF01CPUUJ.27.78.H01.1.454.CMB.1.raw
  modified_base (151)..(151): a, c, t, g, unknown or other
  misc_feature (151)..(151): n is a, c, g, or t
  modified_base (182)..(182): a, c, t, g, unknown or other
  misc_feature (182)..(182): n is a, c, g, or t
tcagagcgtcgtctcacgaccggtgctcgatttagtgtgagtagtttgggtttggggatcttaaaagaggttctttctctgggatgtggcatgagcaaaactaaacaagtcaaggcaggaagatgttgccatcacaactcattgggtttcngctgctctgggttccagccgtccgaggggtntaaattgtgctgactcgagtctccagtacttcagtctgtcgactaccgaaaggaagaacgtaccaccactccaccgtcggccggaccagtacgagagtcggttaggtagtacgtctaactaccgtggtaccgagacagacgacgaggtcacgtctacgaacgctacctacatacaagttacgtacgtccctaccgtaccgttccttaccgtaccggtaccggggttccccgtacggtacggtttaccgacggtcggtcgtaggtacggtacgtcggtacgggactaccgttaccttaccgaccctacgaacctaactactaacgtacgtaccgtaaggaacgtacgtaagaacgttacgtacgtaccgttagtaaccctttaaacgttttaacgttaccgttaacgtacttaaccgttaacgtaaccgttaacgtttaaccctttaacctttaaccgtaacggttaacgtacccgttaaccgttaaccccggttaccggttaaccccgggaacggtaaaccgggaaccgtaaccgggttaacggtaacggttaaaccggtaaaacccgtttaacggtaaacggg

SEQ ID NO: 171376 - DNA, 780 bp, Homo sapiens
  misc_feature: GYAE6OF01D3MG7.27.78.H01.1.454.CMB.1.raw
  modified_base (120)..(120): a, c, t, g, unknown or other
  misc_feature (120)..(120): n is a, c, g, or t
  modified_base (151)..(151): a, c, t, g, unknown or other
  misc_feature (151)..(151): n is a, c, g, or t
  modified_base (240)..(240): a, c, t, g, unknown or other
  misc_feature (240)..(240): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttcngctgctcgtgggttccagcctccgaggggtnaattgtgctgactcagtcctccagtcttgagtctgtacgactacgaaaggagtaacgtccaccatccaccgtcggccggtcagtcgagnggtcgttaggtagtacgtcttacgaccgttcggtaaccagtaccgaaggaccgccgtaggtacctacgtcctaaccgaacgtccctaccgtactacgtacgtaacgttctaccgtccctttacccgtacgtttcccgttcgtaccgggtacccgggttcccctgggttacggttcgtaggtccggacgtacggtacgtacgtaccggtacggaacctacgttaccttaccccacccttaacaaccttaacgtaccgtaacgttaccggtacggtaaggaaccgtcgtaagtaagtcgttacgtacgtaacgttaaccctttaacgtttcgttagtaccgttacgtaactaccggttaagttaccctttaaacttttacccgttacctacggtaacgttacgtacccttacccggttacccggtaccgggaaacccgttaacgggacctacgggtaaccgttaaggtaaccgttaaacgttaacggttccggtcggtaccgaccttacgacccgttacttcggttccgttcgtttaacccg

SEQ ID NO: 171377 - DNA, 797 bp, Homo sapiens
  misc_feature: GYAE6OF01CHXX4.27.78.H01.1.454.CMB.1.raw
  modified_base (154)..(154): a, c, t, g, unknown or other
  misc_feature (154)..(154): n is a, c, g, or t
  modified_base (464)..(464): a, c, t, g, unknown or other
  misc_feature (464)..(464): n is a, c, g, or t
tcagagcgtcgtctcacgaccggtgctcgatttagtgtgagtagtttggggtttgggggggcatgagcaaaactgacaagtcaaggcaggaagatgttgccatcacaactcagtttgggtttctgctgctctgggttccagcctcgaggggtanaaattgtgctgactcgagtcctccagtactttcagtctgtcgactaccgaaaggtaagaacgtccaaccactccgaccgtcgggcccgggacctagtacgaggtacggttcggtttaggtacgtacgtaccttacgacgttacggtaaccaggacgaacggaacggtaccgaacgggtcctacgtaccctaaccgaaacgtccctacctactaacgtactaaagttaccgtcgtaccccttacccgtacgtttccttccggtaccgtaacccggggttcccctagggttaccgggttacgagggtacggngtacggttacggtacgtaccggtacggtaacctaaccgttccttacccacccgtaccaactactactaacgtcgacgttacggaagccgtaagagtagtcgactaacgtaaccttaacttagttaccgttatactaacttaacgtacgttaactttaacccgttttaaccttaacgtacgttacggttaactccctaaccgtttacccgggtacgaaccggtaacgggtaccgaacggtacggaacgggtaaacgttaacgttaaaccgggtcgttaacggtcgggtaaccgtaccgtaccgttaccgtacgtttccgtttaacccggttacc

SEQ ID NO: 171378 - DNA, 665 bp, Homo sapiens
  misc_feature: GYAE6OF01A6FOS.27.78.H01.1.454.CMB.1.raw
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactacgaaaggagaaagtcaccatcacctggccgggcagtcagagtcgttggtagtagcttacacgtggtaccagacagaacgccaggtcagtctaccaaacgctcctacactcaagtactcgaccttcccagtccttctccgaccggggtcccctcggtaggttcaggttggctggtggacgtcgtggactacgtnttccgaccctcactatacgaatacgaccgtaggaacncgtaagaacgtacgtagtacgttacgtaccttaaactttactttaacgttacgtactacgttacgtaacgtaacgtttaaccttaccgtttaaccctacgtaacggtacgtacccttacgtacccgtttaccggaccgaaacgggtaccgaacggtacgtaagggtaaacgtaaacggtttaaaccggaacgtttacgggtcgtaacgtacgtacctaccgtaatttccgtacgttccgtttacc

SEQ ID NO: 171379 - DNA, 817 bp, Homo sapiens
  misc_feature: GYAE6OF01A6VX3.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtgtaaattgtgctgactcagtctccagtactttcagtctgtcgacctaccgaaaggagaaacgtccaccactccaccgtcggccggaccagtcagaggtcgttggtagtagtactacacgtcggtaaccagacgagaacgccgaggtcacgttccaccgaaacgcctacctacatacaagttactcgtaccttccctacgttccttccgtcggtaccgggttccccgtaggtacggttcgaggtcgggacgtaggtacggtacgttcggtacgggacctacgttacctttacccaccccttaccgaacccttaactacctaaacgtaccggtacccgttaagggaaaccgtcgttaacggtaaacggtacgtacggtaccgttaccggtaacctttaaaaccgttttacgttaaccgttaccgttaaaccttacgttaaccgtaaacggttaacccgtttaaaccccttttaaccctttttaacccgaaacggtttaaccggttaccgtttaacccgttaacccccggttaacccgggtttacccggggtaaaccccgggtaaacggggttaaacccgtaccgggttaaacccggtaacggggttaaaaccgttaaaacccgggtttaaaacccgggg

SEQ ID NO: 171380 - DNA, 621 bp, Homo sapiens
  misc_feature: GYAE6OF01AQCC0.27.78.H01.1.454.CMB.1.raw
  modified_base (180)..(180): a, c, t, g, unknown or other
  misc_feature (180)..(180): n is a, c, g, or t
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggggtnaaattgtgctgactcagtctccagactttcagtctgtgactccaaagganaaagtcaccatcaccgtgccgggccagtcagagcgttggtagtagcttacactggtaccagcagaagccaggtcagtcnccaaagcctccncatacaagtatcgcttccccagttccttctcgaccgggtcccctcggcgttcaggtcgctaggtggatcggtagggacactactttccacccctcaccctatacaatacgccgtacggaacgctaggaatactgaccgttcgacttaaccttacgtttaccgtcgtacacgtacaacgtaacgttaaccttaccttttaaccctacgtaacggttacgtacttcccgtaccccgttaccgggaacccgaacgggtaaccctacggaacgttacgggtaaacctaacggtttaaaacccgg

SEQ ID NO: 171381 - DNA, 698 bp, Homo sapiens
  misc_feature: GYAE6OF01BW4J2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaagtcaccatccacctgccggcagtcagagtcgttggtagtagcttacacgtcggtaccagacagaacgccaggtcagtcctacaaagcctcctcatacaagtatcgccttcccagttcccttcgtcgtaccgggtcccctaggtacggttcaggtcggcgtaggtgtacgtcggtaggacctacgtactttccacccctaccaccgtaactacgtaaagtacgtaccgtaaggaacgtccgtaaggtaacgtacgttacgtaccttacgtaaccttaaacgtttactttaacgttcggttaacctagtaccgtaacggttacttaaccctttaacctttaccgtaacgtaacgttacgtaacctttacccgtaacccgttaccgggaccgtaaacggggtaacccgtaaccggtaacgttaagggaacgttaaacgttaaaccggtacggtaggtacggtcgtacgtacctacgtactttccgtacgttccttacccg

SEQ ID NO: 171382 - DNA, 901 bp, Homo sapiens
  misc_feature: GYAE6OF01E5GKE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcagttgggtttctgctgctgtcgggttccagcctccgaggggtagtaaattgtgctgactcgagttcctcctacgtactttcgagtcgtgtcgactaccgaaaggagaactcaccactccgaccgtcggcccgggacacgtacgaggtacggttaccggtttagggtacgttaacgtcgtttaaccgtaccggttacggtaacccaggtaacgaacggaaccggtaccggtaacgggttaccgtacgtaccgtaaaccggtaaaccggtccttaccttaccgtaacgttaacgaaacggtttaccttaccggtaccccgtttccccgttaacggtttccccgtttaccggtaccgggttaccccgggttccccgtacggttaccggttacggtacgggtgtaccgtaggtcgggtaccgtacggtacggtaacctaccttaccgtaccctaccctaccgtactaactactacgtacgtaccgtagacgttacgagaagtcgtacgtacctaacggttacctttaacgttacgtttacgtaccgtaactacgttaaccgtaagtttaaccgttacccttttaaccggttacctaacggttcgttaaccttaccgggttaacccgtaccgggttaacccggaaacccggggttaacgtacccgggtaacggttaaccgggtaattaaaacccgggtttaaacggtaaccggtttaccggggttacgtacccggtacgttacccccggtaaacgttttaccccaagttttcccgggtttaacgttaccccgttaccccg

SEQ ID NO: 171383 - DNA, 625 bp, Homo sapiens
  misc_feature: GYAE6OF01DRR4U.27.78.H01.1.454.CMB.1.raw
  modified_base (539)..(539): a, c, t, g, unknown or other
  misc_feature (539)..(539): n is a, c, g, or t
  modified_base (614)..(614): a, c, t, g, unknown or other
  misc_feature (614)..(614): n is a, c, g, or t
tcagagcgtcgtctcacgaccggtgctcgatttagtgtgagtagtttgggtttggggatgagcaaaactgacaagtcaaggcaggaagatgttgccatcacaactcatttgggtttctgctgctctgggttccagcctccgaggggtgaattgtgctgactcagtctccagtactttcagtctgtcgactaccgaaaggagaaacgtcaccactcaccgtcggccgggcagtcagagtcgttggtagtacgcttacgcgtaggtaccagcgaagaacgccgaggtactacgtactaccgaaacgccttacctactacttacgaacgttacgttcgttacccttacccgtacgttcccgttcctccggtaccgggtttccccgtacggtacggttcgtaggtcggacgtaggtacggtacgtcggtaggactacgtcttaccacctccacactacatacgcgtagacgacgtagaacgagtcgcgtactactaacttacgttactcgtactatacgaagtacttaaccttacttacgtanacgtactactccgtaccgtacgacgtaacgacacgtagacgaagtaacgtaacgacgtggacgctcgacctactntctgtcgttac

SEQ ID NO: 171384 - DNA, 725 bp, Homo sapiens
  misc_feature: GYAE6OF01C7YRA.27.78.H01.1.454.CMB.1.raw
  modified_base (153)..(153): a, c, t, g, unknown or other
  misc_feature (153)..(153): n is a, c, g, or t
  modified_base (188)..(188): a, c, t, g, unknown or other
  misc_feature (188)..(188): n is a, c, g, or t
  modified_base (352)..(352): a, c, t, g, unknown or other
  misc_feature (352)..(352): n is a, c, g, or t
tcagagcgtcgtctcacgaccggtgctcgatttagtgtgagtagtttggggtttggggatgagacaaaactgacaagtcaaggcaggaagatgttgccatcacaactcagttgggtttctgctgctcgtgggttccacgcctccggaggggtntaattgtgctgactcgagtctccagtacctttcgngtctgtacgactaccgaaaagggagtaaaactcaaccatccaccgtcggccggaccagtcgagagtcggttaggtatcgtcttacgcgttcggaaccagaccgtaaggaacggaccgtagggtacctagtacctaccgaaacgtcctcctactatacgagttanccgtccttacccgacgttccctttacgccggtaccggggttcccctacggtacgggttaccagggttcggactacgggtacggacgtttacggagggaaccttacttaaccttacccacccctaaccgtaacaactttacaaacgtaccgggtcgtaacgggtaacgtaccgttaaggtaacgtcggttacgtacgtacgtaaacttacgttttacgttacttagtacctagtacgtaagtaccgtttacttaccttaaccgtactaggttactctaccggtacgttacggaccgtaagaccgtacgacgtacgtaagttaaacgtacgtagtcgtacggtcgtaccgtctaccttcggtatcggttcttacc

SEQ ID NO: 171385 - DNA, 759 bp, Homo sapiens
  misc_feature: GYAE6OF01BTVEG.27.78.H01.1.454.CMB.1.raw
tcagagcgtcgtctcacgaccggtgctcgatttagtgtgagtagtttgggtttgggatcttaaaagaggttctttctctgggatgtggcatgagcaaaactgacaagtcaaaggcaggaagatgttgccatcaacaactctagttgggtttctgctgtctcgttcgggttaccacgccgtccggaggggtataaagttgtgactgactcgagtcctaccgagtactttcgacgttcgtcgtagacctaaccgaaaagggagaaactccaactaactccgtaccgtcggcccggtacctaagtacgaggtcggttacggtttaggtaagtacgttaccttaaccgacgtaccggtaaccagtacgaacggaacgccgtaggtacacgtacctaccgaaacgtcctacctaactactaaccgttaagtaccgtcttcccgttaacctcgttccttccggtacggtcccggttcccgtaggttacgtcggtacgtcggaccgtggtacggaactcggtaacgaacctacttacgttaccctacccgtctaacgtaactcgtaaactggtacccgtaggaaatccgaagtaacgatcgtacgtacgtaacttaacgttacgtaacgtcgttaactaataccggttaactaccgtttaaactttcccgttaacgtaacgttagtaccttacgtaacccgtcgttaacccgggaaactacccgggaagttacccgtaggtaacgtaaacgtaacgttaaaccggg

SEQ ID NO: 171386 - DNA, 703 bp, Homo sapiens
  misc_feature: GYAE6OF01EA0OJ.27.78.H01.1.454.CMB.1.raw
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaaattgtgctgactcagtctccagtactttcagtctgtgacctaccgaaaggagaaagtccaaccatcacctggccggccagtcagagcgttggtagtagcttacacgtgtaccagcagagccaggtcagtctaccaagtcctcctcatcaagtatcgccttccgagttccttcgtcgtacggggtcccctggtacggtttccaggtcggctaggtcggactcggtacgggacctactacgtttccacccctcgaacctataccgaattaccggaccttacgggaacgtccgttaagggtaaacacgttacggtccttacggtaaccttaaaccgttttacttacccgttagttacctaaacgtcgtaacggtaacgttaacccgtttaacccttttacccgtaacgttaaggttccgtaagtttacccggtaccccgtttacccgggaaacccgttaaaacggggtaccctaaacggttaacccgggttaacgggtaaaccgtaaacggtttaaaaaccccggg

SEQ ID NO: 171387 - DNA, 774 bp, Homo sapiens
  misc_feature: GYAE6OF01DDZ8R.27.78.H01.1.454.CMB.1.raw
tcagagcgtcgtctcacgaccggtgctcgatttagtgtgagtagtttgggtttgggggcgatgagcaaaactgacaagtcaaggcaggaagatgttgcccatcacaactcagttggtttctgctgctctgggttccagcctccagggtgaaattgtgctgactcagtcctccagactttcagtctgtgactccaaaggagaagtcaccgatcacctgccggccagtcagagcgttggtagtagcttacgcgtgtaccagacaaggaagaccgacgtcgacgtcctacctaaagcctaccgtacaagtaccgaagtacgtcgccttaccccgacgttcccgttccgtaccgtaccggggtccccctacggtacggttccgtaggtcggaccgtaggtcggaacgttccgtacggggtaaccctaaccgtacgttttcccgacccccgttacgaaccctacgttaccaaacgttacgtacccgttacgggaacgtaccgttacggtaacgtaagttcggtaccgttacggtaccttaaaccgtttacgtttaaccgttacggtaccgttaccttacgtaacggtttacgttaacccgtttaaccgttttaacccgtacgtaaacggttacgtaaccttacccgttaacccgttccggtaacccgtaaccgggtaccgtaccggtaaccgtacggtaaacgttaaccgtttaaacggtaacgttacggtacggtaccgttaccggaccctaaccgtaccgtcgtttaccgttaaccc

SEQ ID NO: 171388 - DNA, 729 bp, Homo sapiens
  misc_feature: GYAE6OF01BID93.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctcagactttcagtctgtgactcaaaggagaaagtcaccatcaccgtgccgggccagtcagagcggttggtagtgcttacacgtggaccagcagaagcaggtcagtctacaaagcctctcatcaagtactgccttcccagtccttctcgacggggtcccctgtaggttccaggtcggcaggtggatcgtagggactactacgtttccaccctcgacctattaccgaaatacgacccgtaggaacgtacgttaggaaacgtacttacgtactacggtacgtttaaaaccgttttaattaaccctttaggtaccctaacgtttaccgtaaaggtaaacgtttaacccttttaacccttttaaaccctacgtaaaacgggtttcgtaaacctttacccgtaacccggtttacgggacccgtaaaacggggttacccgaaaccggtaccggttaagggaaacggttaaaacctttaaaacgggaacgtttcgggggtaaccggtaacgttaacccgggtaaccttaaccccggtaattttacccgggttctttacccggtttaaccccg

SEQ ID NO: 171389 - DNA, 807 bp, Homo sapiens
  misc_feature: GYAE6OF01BDFYL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtggttccagcctcgagggtgtaattgtgctgactcgagtctccagtactttcagtctgtgactacgaaaggagaacgtcacactcaccgtcgccgggccagtacaggagtcggttaggtagtacgtacgttactacgtacggtaaccgacgtacgaagaacgaccggtacgttacgtacgttaccaacctaacgtccttaccctataacttaacgtaaagttcgttaccgtcctttccccgtacgtttccctttaccgcccgggtaccggggttcccctaggggttacgttccgagggtcggtagtacggtggtaactgggtaccggaactccttacgtttacccacccttaccgaacctactaacgtagtaccgtacggtacgtacggtacgttaaggtaagtcgtacggtaccgttacgtaaacgtttaactttaccgtacgtttacgtacctaacggtaactaacgttaacgtttaaaccctttaacgtttacccgtaaccgaaggttacctttaacccgtccggtttaacccggtaacccggaaccgggtaaaccgtcgaaaccgggttacggtaaacggttaaaacgtacgtttaaacggcggttaacgggtacccgtacccgttaagtccccccggttaaattacccgggttctttacccgttccgtttaaccccg

SEQ ID NO: 171390 - DNA, 592 bp, Homo sapiens
  misc_feature: GYAE6OF01EUYYZ.27.78.H01.1.454.CMB.1.raw
  modified_base (322)..(322): a, c, t, g, unknown or other
  misc_feature (322)..(322): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccggcagtcagagtcgtggtagtagcttacactggtaccagcagaagccaggtcagtctaccaaagcctacctnactacaaagtatcgtccttccagtccttctcgtaccgggtccctcggtaggttcgaagttggacacggtggtatcggtgggaaccactactttccaacccctaccaccactcaattaacgcctggaanctgaagntacgctagcctaattacttactcgttcagtcaagtacgttacttaactttacctacgtagttcgtaacttacctaccgtttaccggacctaacgggtaacctacgggaacttacgggtaagtaagttaaaaccgg

SEQ ID NO: 171391 - DNA, 918 bp, Homo sapiens
  misc_feature: GYAE6OF01BRP7W.27.78.H01.1.454.CMB.1.raw
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctctgggttccagcctcagggtgaaattgtgctgactcgagtctaccagtaccttttcagttcgtgtacgaccgttaccgaaaagggaagtaaacggtaccaaccctaactacccgtaacccggttcgggaccccggggtacccaaggttaccgaacggtaacggtaccggggtttttaacgggttaacggttaaccggttacccgtttttaaaccgtaacccggttttaaccggggttaaacccccgaaggaacccgtaaaggggtaaaccggtaccccggtaacggggtttcctaaaccgggtttacccctaaccggtaaaccgttcccttacccttacgtaacttacgtaacggttaacgtttcggtccctttaccccgtacgtttcccctttacgtacccggtaccgggggttcccctacggtacgggtttaccgacggtcggcgtaggtcggtacgttcggtagggtaccacgttactttccaaccccgttcaaccgtaactacgtaactacgtacccgtaggaacgtcgtaagaaccgttatcggtacctacggtaacctttaacgtttacgttacggttcggttaacctaacggtttacgaaggttacgtttaaaccccgtttaacgttttacccgtaaaccgtttaaggttcgtttaaccccgttacccggtaacccgggtttccggaaacccggtaaaccggtaaccgttacggtaaacccggtaggttaaaccgttaaacgttaaaaaccccggg

SEQ ID NO: 171392 - DNA, 736 bp, Homo sapiens
  misc_feature: GYAE6OF01AX7C6.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaattgtgctgactcagtctccagtactttcagtctgtgactaccgaaaggagaaagtcaccatccacctcggccggccagtcaggagtcggttaggtatagtcttacacgtggtaccagacaggaacgccgaggtctacgtcctaccaacgtcctcctacactactaagttactcgtccctttaccctacgttccctttccgtaccggtacccgggttccccgtaggtacggttcgtacggtcggtacgtaggtcggtacgttcggtacgggaaccttacgtacctttaccctaccccgtactaacccgacttacgtaacgtacggtaccgtaggaacggtctaaggtaaacgtgtaccgacgttacgtaacctttaacgtttacttaccgtacttacgaacttaccgtaacgttaaccttttaccgttaaccctttaaccgtacgtaagttcctaaccgtttcccgtaacccggttaccggaaccggtaacggtacccggtagtaaccggtaggaacggttaaacgtaaaccggtgttacgggtacctacgtacccacgtaacccgttcttccgttcgttacccg

SEQ ID NO: 171393 - DNA, 630 bp, Homo sapiens
  misc_feature: GYAE6OF01A6HZ6.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatcgccttcccagttccttcgtcgacggggtccccctcggtacggttcgaggtggtcaggttggattcgtaggggtactactacttttccaccccttacaccctaataccaaatacggcccttagggaacgctaggaagtactcgcttgacctaacgtttattacgttcgtacctatacgacgtaacgtttaacccttaccttttaacctacgaaggttcgtaacttaccgtaccccgttaccgggacccgtaaacggggacctaaccgggagtacgggtaaacggtaaacgttaaaaacccggg

SEQ ID NO: 171394 - DNA, 660 bp, Homo sapiens
  misc_feature: GYAE6OF01CP4KS.27.78.H01.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
  modified_base (539)..(539): a, c, t, g, unknown or other
  misc_feature (539)..(539): n is a, c, g, or t
tcagagcgtcgtctcacgaccggtgctcgatttagtgtgagtagtttgggtttggggggcatgagcaaaactgacaagtcaaggcaggaagatgttgccatcacaactcagtttggtttctgctgctctgggttccagcctcgaggggtnaaattgtgctgactcacgtctcagtactttcagtctgtgacctacgaaagganaacgtcacactcacgtggccggcagtcagngtcgttggtagtagtctacacgtcgtaacngacaagacgcgagtcagtcaccaacgtctccataactcgtaaagttctcgtcccttaccctcgtttcctcgtccgtccgggtttcccctaggtacggttcaggtcgtcgtaggtcgacttcggacggtaactacttacgtttcccacctacaacctaatactaaacgttccgaccgttaagggacgttagtaacgtaagtactcgtacgtacgtacttaactttgtactagtctacgttacaacgttacttacttaacctttactacgtaacgttntaaccttaccgttaccgtacggaccgtaaacgggtacacggtaccgtaagggtaaccgttaaagttaaacggtccggtagtaccggtacgttaccgacctacgttacgttgttccgttacc

SEQ ID NO: 171395 - DNA, 1143 bp, Homo sapiens
  misc_feature: GYAE6OF01BM180.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccgtccgaggggtnaaattgtgctgactcacgtctccagtactttcagtctgtcgactaccaaaggaacgaaaacgtccaacctactaccacccgttcggcccggggaccgaacggttaccgaaggtaggtaccggtttaggggttaaacgttacggttccctttaaaccgaccgtttaccgggttaacccgaacggaccgaaaacgggtaacggtaccccggtaacggggtttaccgaaccggttttacccgttaaccccgaaaaacggttcccctttaccccgttaacctaaactttaaccggtaaaaagttttacccgttaccggttacccccgttttacccccgttaaccggtttccccttttacccggtaccccggggttaacccgggggttaccccccttttacggggttaaccgggtttaccgtaacggggtttacggggtaccgttaaacgggttacgggtaacgttacccggttaaccggggggtaacccttaaccggtttaaccctttttacccccgttaaccccccggtttaaccccgtaaacccccttaaaccgtttaaaccccgttaaaaccgtttaaacccggggttaaccccgttaaaccggggttaaaccggttaacccggtaaacggtaaaacgggttaaccggtttacccgggttaaccgtttaacgggttaaacctttaaaaccctttttaacggttttaaccccgtttaccggtttaaaccgttaaccccttaacgtttaaaccgggtttaaaacggtttaacccctttttaaaaccccgttttaaacccttaaaccggttaacggtttaccgttaaacccggttacccctttaaacccccggggttaccccggttaaaccccggggtaaaacccggtaacccgggttaaaacccggttaaaccgggttaaacggggttaaaacggttaaaacccgggttttaaaaaaccccgggg

SEQ ID NO: 171396 - DNA, 787 bp, Homo sapiens
  misc_feature: GYAE6OF01CFGQY.27.78.H01.1.454.CMB.1.raw
  modified_base (139)..(139): a, c, t, g, unknown or other
  misc_feature (139)..(139): n is a, c, g, or t
  modified_base (183)..(183): a, c, t, g, unknown or other
  misc_feature (183)..(183): n is a, c, g, or t
  modified_base (410)..(410): a, c, t, g, unknown or other
  misc_feature (410)..(410): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactnatttgggttctgctgctcgtgggtccacgccgtccgaggggtanaagttgtcgctgactcagtctaccaacgttacttcgacgtcgtacgtcgtaaccgtaccgaaaaggagtaaaacgtccaacctactccgaaccgtcgggaccgggtacacggttacgaggtacggtcggtttagggtaacgtacggttaccttaacgacggtacggtaaccgaggtaccaacggaacgaccgtaggtacctagtaccctaacgtaacgtctacctanaacgtactaagttactaccgtccttaccgtacgttcccttacggtacccgggtaccgggttccctacgggtaacggttcgacgggtacgtacggtaggttacggaacgttcggtacgggtaaccctacgttaccctttaccaacccccgtactaactacgtacgtaaacgtcggtacccgtaaggtaacgtaccgttaagaacgtactcggtacctacgtaacttaacgtttataccgtatactaagtaccgtacgttaaacgttacttaaccttaacccgattaaccggtctaccgttaaaccggttccggtaccggaaccggttaacgaacccgtaacggaacggttacggtaaaagtttaccggtaaaaccggg

SEQ ID NO: 171397 - DNA, 672 bp, Homo sapiens
  misc_feature: GYAE6OF01EVPCD.27.78.H01.1.454.CMB.1.raw
  modified_base (185)..(185): a, c, t, g, unknown or other
  misc_feature (185)..(185): n is a, c, g, or t
  modified_base (360)..(360): a, c, t, g, unknown or other
  misc_feature (360)..(360): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcaacaactctagttgggtttctgctgctctgggttccagtcctcgaggggtanaaattgtgctgactcagtcctccagtactttcagtctggtcactaccgaaaaggacgaaacgtccaacctatccaccgtcggcccggcagtacagacggtcgttaggtagtacgtcttaacacgtacggaacctagacgaagacgcgtagtcacgtcctaccgaatcctacctanatactaagtctaccgtaccttacccgtacttcccgttacgtacggtacccgggtccctacggtacggttcgaggttcggcgtaggtcgtagtcgtacggaactacgtttaccttacccacctaccaccgtaactataacgtacgacgtaggaactgtaacgagtacgtacgtacgtactaaccgttaactttagtacctagtacctactacgaacgttacccttaacttaccctttacgtactaagtaccgtactacccgtacgtcccggaaacgtaacggtaccaggtacgtacggtaaataacgtaaacg

SEQ ID NO: 171398 - DNA, 835 bp, Homo sapiens
  misc_feature: GYAE6OF01CQM4Q.27.78.H01.1.454.CMB.1.raw
  modified_base (199)..(199): a, c, t, g, unknown or other
  misc_feature (199)..(199): n is a, c, g, or t
  modified_base (534)..(534): a, c, t, g, unknown or other
  misc_feature (534)..(534): n is a, c, g, or t
tcagagcgtcgtctcacgaccggtgctcgatttagtgtgagtagtttgggtttggggatcttaaaagaggttctttctctgggatgtggcatgagacaaaaactgaacaaagtcaaaggcaaggaagattgttgccatcacaactctatttgggtttctgctgctcgtgggttccacgtcctcggagggtagtaattgngtctgactcacgtcctactaagttactttcgacgtcgttgtacgtaacctaaccggaaaaggaaagtaaacgtaccaacctactacccgtacccggtacgggacccggacagtacgaacgtaggtcggttaggaacgttacgtacctaacgtacgtacgtaaccgagacgaggaacgtaccggaggtacctaacggtcctaaccaacgttcctaccgtaactaacgtactaacggtacttaccgtccttacccgtacgtttccctacgtacccggggtacccggtcccgttaaggtcggtttaccgaggtcgaggtacggttagtaacgttcggnggtaaccttaccttacccttacccgacctaccgtaactacgtaaaccgaaacgtaccggtacgtaaggtaacgtaagtaacggtaacgtacgtaccgtaacgttaccgttaaactttaatttaacccgtttacgtcgttaactaccttaaggtaaccttaaacggtttaaccctttaaacttccgttaacgtaacgttaaccgttaccttacccggttaaaccccggtaccgggaaaccgggaaccgttaaccggtaaaccggtcggtaaaaggttaaaccggttaaaccttaaaacgggg

SEQ ID NO: 171399 - DNA, 784 bp, Homo sapiens
  misc_feature: GYAE6OF01BGXA1.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtntaaattgtgctgactcagtctccagtactttcagtctgtcgactaccgaaaggagtaacgtccaaccataccaccgtcggcccggaccaggtcaagagtcggttaggtacgtacgtaccttacacgttcggtaccagacgaagaacgccgacggtcactcctaccgaaacgtcctcctactactaccgaagttactcggtcccttacccgtacgttccctttaccgtccggtacccgggttcccctcggtacggttacgagggtcgcgtaggtcggtactcggtaggtactaccttacgttacccaccctaccaacctactaccgtaacgtaccggaccgttagggaaacgtcgtaaggaaacgtacgttacgacgttaacgtaacctttaaacgtttaacgtttaccgtagtttactaacgttaccgtaacgtttaaccgtttacctttaacccgtttaacccgttaaccgtaacggtttaaccgttaacccttacccggttaacccggtttaaccgggaaacccggaaacgggtaaccgtaaccggtaaggttaacgggaaactttaaacggtaacggttacgtacgggtacggtaacttccggacctaacccgtctttcgtccgtttaaccg

SEQ ID NO: 171400 - DNA, 821 bp, Homo sapiens
  misc_feature: GYAE6OF01E5KQG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtcctgtcgactaccgaaaggagaaacgtccaaccatccaccgtcggccgggccagtcaggacgtcggttaggtagtacgtacttacgacgtaggtaccgagacgacggaacgccgaggtacctacgtacctacccgaaacgcccttaccgtacctaataccgtaaaggttactcgtacccttacccgtaccgttcccgtttaccgtacccggtaccggggtttcccccgttacgggttacggttacgtacggtcggaccgtacggtacggtaacgtccgtaacggggtaacctaaccgtacctttacccaaccccgtaccaacctaactacccgtaaagtaccgtaaccggtacggaacgtacgtaaggaagtacgttaggaccgttacgtaacctttaaactttatttaccgttacgttacctaacgtaccgtaacggtttaaccgtttaacccgtttaaccttttaccgtaacgtaacgttaccgtaaccgttaccgtaacccgtttacccgggaaccggtaaacgggtacccgtaacgtaacgggttaacggtaaacgtaaacggttaaaccgtacggtcggttaccggacttcccgtacgtacccttacgtttcccgttcggttccctttaaccccg

SEQ ID NO: 171401 - DNA, 839 bp, Homo sapiens
  misc_feature: GYAE6OF01B6JMC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccgaaaggagaaagtcaccatccaccgtcgccggccagtcagagtcggttggtagtacgtcttacacgtcggtaaccagacaacggaaacgccgtaggtccacgtcctaccgaaacgtcctaccgtacactacgaagttactcgtccttacccgaccgttcctttcgtccgaccgggttccccgtacgtacggttccgacggtggaccgtaggtacggtactaccggtacgggaacctaacgttactttaccccgacccgtaccaaacctacttacgtaaacgttacggtacccgtaagggtaaccgtacgtaagggtaaacgtcgttaccgtaaccgttacggttaacttaaacccgttttacgtttaaccgttaacgtaaccgtaacgttaacctaaacggttaaccgttttaacccgtttaaacccgttttaccccgtaaacggttaacgttaaccgtaaccctttacccggttaaaccccgttaccgggaacccggtaaacggggaacccttaaacggggtaaccgttaacggggaaacggtttaaaacctttaaaacccggggaacgttttccgggtaccgggttaaccctaaccgtaacccgaaccgtttaacggcccttttaacgggttcccctttaaacccg

SEQ ID NO: 171402 - DNA, 744 bp, Homo sapiens
  misc_feature: GYAE6OF01A8J7U.27.78.H01.1.454.CMB.1.raw
  modified_base (525)..(525): a, c, t, g, unknown or other
  misc_feature (525)..(525): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcttgggttccacgcctccgaggggtagaaagttgtgctgactcagtctccagtacttcagtctgtgacctaccaaaggacgaaacgtcaacctatcaccgtcggccgggccagtaccgaggaggtacggttaggtacgtagtacttacacgtgtaccgagacacggaacgtccgacggtacgacgttccgtaaccaaacgtcctacctacaatactagtactctcctcctacgtccgttacgcgtaccgggtccctcggtacgtcgaggtcggacgtaggtcggtacgtcggtacggacttacctacttcccgaccctaccaactcgtaacaacgtacgtccgtaaggacgtacgtagaacgagttacnccgtacgttaaccttagtttaactttacgtaccgttaactacgtacggtaaacgttaccggtttaaccttaacccttttaaccgaaccgttaacggtaccgttacccgtacccgttaaccccgggttaaccgggaaacccggttaaaccggggaaccgttaacccgggtaaaccggttaaacggggtaaaacccgtttaaacgggttaaaaaccccggg

SEQ ID NO: 171403 - DNA, 789 bp, Homo sapiens
  misc_feature: GYAE6OF01CZ35F.27.78.H01.1.454.CMB.1.raw
  modified_base (758)..(758): a, c, t, g, unknown or other
  misc_feature (758)..(758): n is a, c, g, or t
tcagagcgtcgtctcacgaccggtgctcgatttagtgtgagtagtttgggtttggggatacttaaaagaggttctttctctgggatgtggcatgagacaaaactgacaagtcaaggcaggaagatgttcgccatcacaactcattgggttcctgctgcttcgtcgggttaccacgtccgtcgaggggtataaattgtgctgtactcacgtctaccacgttacttctagttcgtgtctaaccgtaaccgaaaggtaacgtaaacgtaccaacctactccgtaccgtcgggcccggtacgtacgtacgacggtacggtacgggttaggttagtacgttaccttaaccgtacggttaccggtaaccgaggaaccggtaaaggtaaccggtaccggtaacggttaccgtaacggttacccgtaaccgtaaaccgtccttacccgtaactacgttaaccgttaaacggttacttacccgggttcctttaccccggttacgtttccccgtttaccggacccggggttaaccccggggtttccgtacggttacggttacgtacgggttcggtacggtacggttaggtaaccgttcggtaacggtaccttacttaccgtttacccaccttaacactactactaacgtcgacgtagacgtagtagactcgtcgtacgttactactttaacttcgttactacgtacttaagtactacgtacctttaaccttacgtactagtcgtactcgttacccacgtaccgggaanacggttacacgtagaaacgtgtaaagtaccg

SEQ ID NO: 171404 - DNA, 660 bp, Homo sapiens
  misc_feature: GYAE6OF01ESELY.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggcagtcagagcgttggtatagcttacactggtaccagcagaacgccaggtcagtctacaagctcctcatacaagtatgtccttcccacgttccttccgtaccgtacggggttcccctacggtacggtttcgacggtggaccaggtaggactcgtaggggacctactacgtttccacccctaccacctatacctaagtacgtaccgtaggaacgtcgtacgaaggtatgtctacgtacctaaactttacttactacgtactatacgtaacgtacgttaacgtttacctttaaccgtacgtaagttacggtacttaccgtaacccgttaccgggaaccggtaacgggaccgtaaccgtaacggtacggaaacgttaaacgttaaaacggtaccgtacggtacgtaccgtacggacaacccgtacttaccgtcggtttaccc

SEQ ID NO: 171405 - DNA, 828 bp, Homo sapiens
  misc_feature: GYAE6OF01D5V1O.27.78.H01.1.454.CMB.1.raw
tcagagcgtcgtctcacgaccggtgctcgatttagtgtgagtagtttgggtttggggatacttaaaagaggttctttctcgtgggatgtggcatgagacaaaactgacaagtcaaggcaggaagatgttgccatcaacaactctagttggtttctgctgctcgtggtccagcctcgaggggtataaagttgtgctgtactacgtacgtcctaccgtaagttactttacagttcgtagtacgaaccgtaaccggaaaaggaacgtaaacgtaccaacctacgtaccgaaccggtcggacccgggacaacgtaccgtaaggtacggtacggttaggtacgtaacgtaccttaacgtacgtacggtaacacgacgaacgaacgccgaaggtactaacggtactaaccgaaacgtcctactagaacgttaacgaaacttacgtcgtaccttcctacgttacccttcggtaccggtaccgggtacccgtacggtacggtttacggacggttacggtacgtacggtaggtacgtaccgggtaaccgtaacttaaccgttacccgtttaacccaccttaaccgtaacgtaaccgtaaactaacgtacggacggttaaacggacgttacggaacgtacgtacgttaccgtacgtaactaaccgtttaaacttacgtaccgtttaataccgtaaattaaccggtaacgttaccgttaaacttttaacccgttaacgtaacgttaagtacgtaaccccgtaaccgttaccgggaaacgtacccggaaaacggtaacctacggggtaaattaaccgggaaatttaaacccgggaaaacg

SEQ ID NO: 171406 - DNA, 706 bp, Homo sapiens
  misc_feature: GYAE6OF01CD7RE.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtnaaattgtgctgactcagtctccagtactttcagtctgtgactaccaaaggagaaagtcaccatcaccgtggccggcagtcagacgcgttggtacgagtcttacacgtggtaccagacgtagaacgaccgaggttcacgtccaccgaaacgcctcctacactacaaagtgtacgcccgttaccagttcccttcgtaccggtacggggttccccgtcggtacggttcgtaggtcggctaggttcgacgttcgtacgggaacctactacccgtttccaccccgttccaaccgtaacttaccgtaaacgtacccgtcggttaacggtaaacggtacgtaacgtaagtacgtttacgaccgttacgtaaaccgtttaactttacttaaacggtttccgtaacttacgtaaccgtacgtaaaacgtttacccttaccgtttaaacctacggttaacgttagtacctaacccgtcggttacccgaaccggtaaccggaacctacgagtaacggtaacgtaaacgttaaaccggg

SEQ ID NO: 171407 - DNA, 738 bp, Homo sapiens
  misc_feature: GYAE6OF01BCG7L.27.78.H01.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (316)..(316): a, c, t, g, unknown or other
  misc_feature (316)..(316): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctcgtgggttccacgcctccgaggggtataaattgtgctgactcagtcncagtactttcagtctgtgactaccgaaagganaaagtcacatccactcggccggaccagtcagacgtcgttaggtagtagtaccttacacgttaggaccaggacaaggaacnccgtacgttcaaccgttcgaacctaaaggccttaccacaagttacaaagttactccgtacccttcccaacgtttcgttcgaccggtacccggggttaccctgggtaacgttcgaaggggtcgacggtagtacgggtcttaccgggtaagggtaacctacgttaccgtttacccgtaccccgtaccgtaaccctaacgttaccgaacgtaaccgtaccgttacggaacgttacgtacggtaaagtacgtacggtactacggtaccttaaacttacgtttaacttacgtacgttactaacggtacgtaaccgtttaaccttaacctttaccgtaacgttaacggtcgtaaccttacccgtaccggttaccggaaccggtaacggtacgtaaccgtaaggtaacggtaaaggtaacgttaaacgg

SEQ ID NO: 171408 - DNA, 787 bp, Homo sapiens
  misc_feature: GYAE6OF01E0WE8.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactacaaaggagaaagtcaccatccacctggccgggccagtcagagtcggttggtagtagcttacactgtaccagcagaagccaggtcagtcctaccaaacgtcctcctacactacaagtactacgtcccttcccctacggttcccttccgtaccgtacggggttccccccgttcgggtaacggtttccgtaggtcggtaccgtaaggttagggacttccggtacggggacctaaccgttaacttttcccgaacccccttaccgtaacccctaatacctaaacgttaccgacccgttacgggaacgtccgtaaggaacgtacgttacggtaccgttacggaacctttaaacctttaacgtttaccgttagttacctaacgttaccgtaacggttaaccgtttaacctttaacccgttttaacccgtaacgttaaacggttcgtaaccgttacccgttaacccgttacccgggtaacccgaaaaccggggtaacctaaccgggtaacgtaacgggtaaacgttaaaccggttaaaacgtaccggttacgggtacggtactacggtaccctaaccgtaacgtttccttacgtccctttaacccg

SEQ ID NO: 171409 - DNA, 713 bp, Homo sapiens
  misc_feature: GYAE6OF01B9USH.27.78.H01.1.454.CMB.1.raw
  modified_base (646)..(646): a, c, t, g, unknown or other
  misc_feature (646)..(646): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctcagactttcagtctgtgactacgaaaggagaaacgtcactatcaccgtggccggccagtcagagtcgttggtagtagcttacgcgtagtaccagcaagaacgccaggtaccagtaccttaccgaaagtcctacctactacgtacctaagttaagtccgtacctttccccgtacgtttaccccttttaccggtcccggtaacccggggtttcccccgttcgggttaacggttccgtacgggttcggaccgtaaggtcgggtacgttcgggttacgggaacctacttacgtttacccgacccgtactaacctaacgtcctaaagtaccggtactaacgggtaacgtacgtaggtaagacgttacgacgttacgaaccttaactttacgttactacgttacacttacgaagttaacgttacctttaacttcttaacgtaagtactacgttacctaccgttacggacgtaacggacaccggtanaggtaacgtaaacgttaacgacggttgacgtacgtactaccgacctagtttacgtcgtctttacccg

SEQ ID NO: 171410 - DNA, 775 bp, Homo sapiens
  misc_feature: GYAE6OF01CFJ0R.27.78.H01.1.454.CMB.1.raw
  modified_base (126)..(126): a, c, t, g, unknown or other
  misc_feature (126)..(126): n is a, c, g, or t
  modified_base (132)..(132): a, c, t, g, unknown or other
  misc_feature (132)..(132): n is a, c, g, or t
  modified_base (156)..(156): a, c, t, g, unknown or other
  misc_feature (156)..(156): n is a, c, g, or t
  modified_base (187)..(187): a, c, t, g, unknown or other
  misc_feature (187)..(187): n is a, c, g, or t
  modified_base (225)..(225): a, c, t, g, unknown or other
  misc_feature (225)..(225): n is a, c, g, or t
tcagagcgtcgtctcacgaccggtgctcgatttagtgtgagtagtttgggtttggggatacttaaaagaggtttctttctcgtgggatggtggcatgagacaaaactgacaagtcaaggcaggaanatgttnccatcaacaactcagtttggttcngctgtctcgtggtccagtccgtcgagggtanaagttcgtgctgacctctagtcctaccgagttccttanacgttctgtacgaacctaacggaaaaggacaaacgtaccactactccgtaccgcgggaccgtacgacggtacgaggtacggtacggtttacggtaacgttacgtacgttaaccgacgttaacggtaccacggaacgaacggtaaccggtaccgacggttcacgtaaccaccgaacgtcctacactacgtactaagttactccgttaccttacccgtacgttcccgtacgtacccggtccggttccccgttaggttaacggttcgacgggtacggtccgtaggcgttaacgtccggacggtacttacttaccgttacccacctacaaccttacgtaacgaacgttcgtaccgtaaggacgtacgtagaacgtctacgtaccgtaacgttacctaaaccgtttagtcctaacgttactacgtaacggttaccgtaacctttacgtttaacccgtacgttaacgtacttacgtaacccgtttccgtaaaccgggttaacccgtaaaccggacgtaaacggtactagggttaacaaaccgtttaacggtaacgg

SEQ ID NO: 171411 - DNA, 823 bp, Homo sapiens
  misc_feature: GYAE6OF01DT6CP.27.78.H01.1.454.CMB.1.raw
  modified_base (168)..(168): a, c, t, g, unknown or other
  misc_feature (168)..(168): n is a, c, g, or t
  modified_base (796)..(796): a, c, t, g, unknown or other
  misc_feature (796)..(796): n is a, c, g, or t
tcagagcgtcgtctcacgaccggtgctcgatttagtgtgagtagtttgggtttggggatgagcaaaactgacaagtcaaggcaggaagatgttgccatcaacaactcattgggtttctgctgctcgtgggttccagcctccgagggtagaattgtgctgactcagtcnccagtactttcagtctgtagactacgaaaggagaaacgtcaccatccacgtcggccgggccagtcagagtcgttaggtagtacgctacacgttcgaacagacaagacgacgagtaccgagtcctaaccaacgtcctactcctaataccgtaaagtacgttcgtccttacccgtaccgttccttaccgtaccgggtacccgggtacccctacgggtacggttaccgtacggtcggacgtaggtttggacgttacgtacgggaacctaacgtacctttccctaacccgtactaaacctaataaccgtaaacggttaaccgtccgtaaacgggtaacgtaccggtaaagggtaaggtacgttacggttacggtaacgttaaaccttaaacctttttacgttaaacggttccgttaactaaaccggtttcgtaaacgttaaccctttaaacgtttaacccttaaccgtacggtaaacgtacgttaaacccgttacccggtttaaccccgtaacgggtaacccgggtaaacgggtaaacccaacggggttaaccgttaaggggtaaaacggttaaaccgtttaaaaccggtaacggttcgggtaccggtactaaccggtaccttaaccggttntttaaccgtttcggtttaccttaaccg

SEQ ID NO: 171412 - DNA, 940 bp, Homo sapiens
  misc_feature: GYAE6OF01BN8CO.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtcaccatcacctggccgggccagtcagagtcgttggtagtagcttacacgtggtaccagacagaacgcccgaggtccagtcctaccaaacgcctacctacatacaagttacgtcgtccctttacccgacgtttccctttccgtaccggtaccggggttccccctacggtaacgggtttccgaacgggttcgggacgtaagggttgggtaacgttccggtacggggaaccctaaccgttaacgttttaccccaacccccttaccaaaccccgtaacttaaccgaaacgtttaaccgggtacccggtaaggggtaaaccggtacgttaaacgggtaaaggtacgttcggtaaccgttacggttaaaccctttaaaacccgtttttactttaaaccggttcgtttaaccgtaacgttaaccgttaacggttaacccgttttaaacccgttttaacccttttaaaccccgttaacgttaaaccgggttaacgtttaacccgtttaacccccggtttaaccccgggttacccggggtaaacccccggtaaaaacgggggtaaccccgttaaaccggggtaaccggtttaaaaccggggtaaaaacgggtttaaaaacccgggttttaaaacccggtaaacccggggtttaaccgggttaacccggggttaccggttaacccggtaaacccccgttaaccccggttaacgtttcccgttttaccgggtttttaaaccccc

SEQ ID NO: 171413 - DNA, 793 bp, Homo sapiens
  misc_feature: GYAE6OF01DBV2X.27.78.H01.1.454.CMB.1.raw
  modified_base (182)..(182): a, c, t, g, unknown or other
  misc_feature (182)..(182): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagccctccgaggggtnaaattgtgctgactcagtctccagtactttcagttctgtcaacctaccgaaaaggaagtaaacgtccaaccactaccacccgtcggcccgggaccagtacgaggacggtcggtttagggtagtacgtccttaacgacgtacggtaaccagaccaaggaacgccgaggtccagtcctacgaacgtcctcctacatacaagtatccgtccttcccgtacgttcccttccgtaccggtaccggggtttccccctacgggttacgggtttaccgtagggtccggtacggtaaggttacggtacgttaccgggttacgggaaccttacctaccgttttaccccacccctacctaaccctattaaccaaacgtccgtaccgtaggtaaacgtcgtacgtaagtactacgccgtacgtaaccctttaacttttaaccgtttaacgtcgttaacctacggttaacctaacgttaacgttaaccccgttttaaacccttacccgtacgtaaaccggttacgtacgttaaccccgttaccggtttacccgggaaacccggtaaacgggaaccccgtaacggtaccggtaacgggtaaacgttaaacggtttaaaaacccgg

SEQ ID NO: 171414 - DNA, 647 bp, Homo sapiens
  misc_feature: GYAE6OF01B3KJP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtcgaaattgtgctgactcagtctccagactttcagtctgtgactccaaaggagaaagtcaccatcacctgccggccagtcagagcgttggtagtagcttacactggtaccagcagaagccaggtcagtctaccaaagctcctcatcaagtatgccttcccgagttcccttctccgacggggtccccctgacggttcagtggacagtgactcgtagggacactactttccgaccctcgaccagtaccaaagtacgccgttaggaacgtcgtaggaacgtattacggactacggtacctaaaccgttttagttaacttcgtactaacttacgaagtaacggttaacccttaacttttaaccctacgtaaacggttactacgttacctaaccgttcccggaccgtaacggggaccctaacggaccgttacgggaaacgtaacgttaaaaccggaacgttgggtacgtacgttcgtaccaacttattcccgttgtcccgtttaaccg

SEQ ID NO: 171415 - DNA, 871 bp, Homo sapiens
  misc_feature: GYAE6OF01BUROT.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgacctaccgaaaaggagaaacgtccaaccatccaccgtcggccgggccagtcagacgtcggttaggtagtagtcttacacgtggtaccagcaagaacgccgaggtcacgtacctaccgaaaacgtcctaccctacactacaaagttactcgtccctttacccgtacgttccctttccgtccggtaccggggttcccccttacggtacggtttacgacggtacgggtcgtaacggttacgggacgttccggtacggggtaaccctaaccgtttaaccgttttaccccgaaccccccttaccgaaacccctaacgttaacccgtaaacgttaaacccggtaccccgttaaaggggaaccgtaccgtaaacgggaacgtaacgttacggtaccgttacgtaaccgtttaaaaccgtttttaaccgttaacgttaccgtaacttaaaccgttacgtaaacgttaaccgtttaaaacccgttttaacccgttttaaacccgttaaaccggttaaaagtttaccggtaaactttaccccccggtttaaaccccgggtttaccccgggaaaaccccggggtaaaacgggttaaaccccggtaaaccgggttaaaccggttaaacggggttaaacggttaaaaacggtttaaaaacccgggg

SEQ ID NO: 171416 - DNA, 671 bp, Homo sapiens
  misc_feature: GYAE6OF01ERVV7.27.78.H01.1.454.CMB.1.raw
  modified_base (368)..(368): a, c, t, g, unknown or other
  misc_feature (368)..(368): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagactttcagtctgtgactaccgaaaaggagaaacgtcaaccatcacctgccggcagtcagagtcgttggtagtagcttacacgtaggtaccagcagaagccaggtcagtctacaagctacctcatacaagtatcgtccttcccagttcccttctccgacggggttcccctcgtaggtcagtgacaggtgatcgnggacactacttcaccctacgacatacaagtacgaccgtaggtaacgccgtaggtaacgagtcgactacgtacctaacttttaattaacttcggtactaactacgtaacggtacgttaaactttcgttttaaccctaacgtaagttctaacgttacccgaaccgtttaccgggaaccgtaaacgggaaccctaaacggttaaccggtaacgggaaacgttaaaacgtttaaaacccggaaacggttacgggtaccgggtaacgtacctaccgtaaaccgtaccttccggttacgtttaaccccg

SEQ ID NO: 171417 - DNA, 902 bp, Homo sapiens
  misc_feature: GYAE6OF01EO7IB.27.78.H01.1.454.CMB.1.raw
  modified_base (124)..(124): a, c, t, g, unknown or other
  misc_feature (124)..(124): n is a, c, g, or t
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaaagaggttctttctctgggatgtggcatgagacaaaaactgacaagtcaaggcaggaanatgttgccatcaacaactcattgggttctgctgctcgtggtccagcctcgagggtanaattgtcgctcgactcgtacgtcctctagttcttcacgttctgtacaccgtaacgaaaaggagtaaacgtccaacctactaccgtacccgtcgggaccccggtactacggtacgtaacggtacggttaccgggtttaagggtaacgttaacggttaacccttaaccggttaccggtaaccggttaacccggaacggaaccggtaaacggtaaccgtaccgggtaacggttaccgtaaccgttacccgtaacccgtaaaacgttcccgttaacccttataacgtaaccgttaaaggttccttaccggttacccccttaccggttaccttttacccggttaccggtacccgggttcccggggttaccccgtaacgggtacgtttacggaggttaccggtcggtaacggttcgggtactaccgggttaaccggtaaccttacctttaaccccggtacccttacccgttacccgaaacttaaccgtaacgtaaccggtacgaccggtaacggtaccgtagtaccgaaaggtcctacggtaaccttaacttaaccttaagtttaacccgtacgttacgtaacttaacgtaaccgttaaggttaacccgtttaacctttaacccgttaccgaagtaacgttcccgttaaacgtacccggttacccggtaaggaacccggttaaacgccgttaaacgtaggtaacgttaaaccgtaaacgttaaccgg

SEQ ID NO: 171418 - DNA, 671 bp, Homo sapiens
  misc_feature: GYAE6OF01CRKNT.27.78.H01.1.454.CMB.1.raw
  modified_base (151)..(151): a, c, t, g, unknown or other
  misc_feature (151)..(151): n is a, c, g, or t
  modified_base (342)..(342): a, c, t, g, unknown or other
  misc_feature (342)..(342): n is a, c, g, or t
  modified_base (489)..(489): a, c, t, g, unknown or other
  misc_feature (489)..(489): n is a, c, g, or t
  modified_base (502)..(502): a, c, t, g, unknown or other
  misc_feature (502)..(502): n is a, c, g, or t
  modified_base (638)..(638): a, c, t, g, unknown or other
  misc_feature (638)..(638): n is a, c, g, or t
  modified_base (656)..(656): a, c, t, g, unknown or other
  misc_feature (656)..(656): n is a, c, g, or t
tcagagcgtcgtctcacgaccggtgctcgatttagtgtgagtagtttgggtttggggggcatgagacaaaactgacaagtcaaggcaggaagatgttgccatcacaactctattgggttctgctgctcgtgggtccagcctcgaggggtanaattgtgctgactcagtctaccagtactttacgagtctgtacgtacctaacgaaaaggaagaaactcaacctataccgaccgtcgggaccgggacacgtacgaggtacggttcggtaggtaagtacgtacctacgtacgtacggaccagacgaaggacgtcgtagtactacgtactacaacgctctactanactaacgtctcgtcctacgtacgtcctcgaccgtacgggtccctaggtacgttacgaaggtcggaacgtaagggtgacgttacggacggtaaactacctacgtttacccacctacaactagtactaacgtaccgtacgagggtaacncggtaagaacgtntacacgttagtaactaacgtttatacgtactactaagttaacgagaaaccttttacttaacgttaacctaagaacggttactaaccgtccgtaaccggtacggaaccgaggaccgtagtagaggtaacaaggttanacgtggtacacgtaccanaacgtctcgtcttac

SEQ ID NO: 171419 - DNA, 534 bp, Homo sapiens
  misc_feature: GYAE6OF01EMF4T.27.78.H01.1.454.CMB.1.raw
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (525)..(525): a, c, t, g, unknown or other
  misc_feature (525)..(525): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtcccttctccgacggggtcccctcgacggttcaggtggcagtggatcgtgggacactactttccaccctcacctataccaaatacgcctaggaacgctagaagatgctagtactaaactttattacttgtacatcagattacctactttaccnctaagtntactcaccgttcggacaagggacacgtactggaagtaattaaacgattgagctacgcacntctgtctac

SEQ ID NO: 171420 - DNA, 836 bp, Homo sapiens
  misc_feature: GYAE6OF01A6AKV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccatactttcagtctgtgactccgaaaggagaaacgtcaaccatccacctcggacccgggccacgtcgaggtacggtcggtttaggttaggtacgtccttacgaaccgttcgggtaaccaggacaagaacggccgaggtcacgtacctaccaaacgtcctcctactactacgtaagttactcggtacccttcccgtacgttccctttccgtaccgggtaccgggttccccgttacggtacggtttacgtagggtcggcggtaacgggtcggtacgttacggtacgggtaactaacccgttaccttttacccaaccccgtacctaaccctaactaccgttaaacgtaccgtaccggttaaggaacggtacgttaacgggaacgtacgttacgacccgttacgaacccgttttaactttaacgttaaccgtttgttaacccgtaagttaccggtaaacggtttaccgtttaaacccttttaacccgttttaaccctaacggttaacggtttaccgtaccttaacccggttacccgttaacccggggaacccgtaaacgggtacctacgggtaaacccggtagggttaaacggtaaaccgtttaaacggtacggttcgggtaaccggtacctacgtaaccctacttaccgttccgtttcgtaccgttacccg

SEQ ID NO: 171421 - DNA, 722 bp, Homo sapiens
  misc_feature: GYAE6OF01DVDQ0.27.78.H01.1.454.CMB.1.raw
  modified_base (145)..(145): a, c, t, g, unknown or other
  misc_feature (145)..(145): n is a, c, g, or t
  modified_base (196)..(196): a, c, t, g, unknown or other
  misc_feature (196)..(196): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggtccagcctcgagggtnaattgtgctgactcagtctccagtactttcagtctgtgactacgaaagganaaagtcaccagtcaccgtggccggactagtcagtacgtcgttggtagtacgtcttacgtacgtggtaccagcgaagaacgccgaggttaccacgttacctacccgaaagtccccttacctacaactacgtaaacgttacgtccggtaccctttaccccgacgttttcccgtttaccgtacccggttaacccgggtttcccccgtacgggtaacggtttcgaacggtcggtacgtaggtcggtaacgtcggtacgggaacctacgtacctttacccaccctactaacctataccgtaactcgacgttagggaactcgtaagaagtcgtcgtacctagtaccttaactttactttacgtacgtactaacgttactaacgttacgtttaacctttaaccgttaacctacgtaaacggtctaacccgttcgtaacccgtcggaaccgtaaacggacctaccgtagtacggtaaagttaacgttaaacgcgttagtcgacgtacggtaccacttcttcgtcgtttaacccg

SEQ ID NO: 171422 - DNA, 848 bp, Homo sapiens
  misc_feature: GYAE6OF01E12AE.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggtccagcctcgaggggtnaattgtgctgactcagtctccagtactttcagtctgtgactaccgaaaaggagaaacgtccaccactccaccgtcggcccgggaccaggtccaggtacgtcggtttaggtagtagtcctttaaccgacgttcggtaaccaggtacaaggaacgcccgtagggttaccacgttaccgtaacccgaaacgtccctaccctactacgttacgaagttactcgtaccctttaccccgaacgttccctttcggtaccggtacccggggttccccgttacgggtacggttacccggtaaggttccggggactaaggggttacgggtaacgttccggtaccgggggtaaccctaacgttaccgttttaccccaacccctaccgtaaacccgtactaaccgtaacgttaccggtacccgtaaggtaaccgtcgttaaggaacttacgtacgtccgttaggtaaccctttaacgtttacgttaacgtcgttaccgtaattaccggtaacgtaacgtttaaccctttaaaccgttttacccgtaagtaacgttacgggttaaccttacccgttaaccccgttacccgggaaccggttaaacgggacccgtaaaccgtacggttaacgggtaaacttaaaccggttaaacggtacgtttacgggacttacccgtaccggtacaaaccccgttgttaccgttccgttacccg

SEQ ID NO: 171423 - DNA, 683 bp, Homo sapiens
  misc_feature: GYAE6OF01BAJAF.27.78.H01.1.454.CMB.1.raw
tcagagcgtcgtctcacgaccggtgctcgatttagtgtgagtagtttgggtttggggatgagcaaaacgttgactaagtcaaggtcaggagactgttgccatcacaactcagttgggtttctgcgtgctcgtgggttccacgccgtccaggggtgaaattgtgcctgactcagtcctccgagacctttcagtctgtgactaccgaaggactaagtccacctagtccaccgtggccgggacagtacgagtaggtcgttggtaatacgtcttacacgtcgtaccagcgaagacgaccgtaggtctacggtccaccgaacgtcctaccgcctactactaaggtacttccgtaccgttccctaagttcccgtttacgtaccggttaccgggttcccctaggtaaggttccacggtacgtcggagttggactggtacggacctacgtacgttaccacccgttccaacgtattacgaacttacggaccgtaggacgtacgtagaagtactcgactacggtaactttacttagttacgtagtactatacgtacgttacgtaccttacgtacgtaccgtagtactaccttacctaccggttacgaccgtacggaccgtaccgtagaccgtaagtacgtaaccgttacgtaggttcgacgtaccgaccacctatccgttcgtccgttacccg

SEQ ID NO: 171424 - DNA, 775 bp, Homo sapiens
  misc_feature: GYAE6OF01BVM9T.27.78.H01.1.454.CMB.1.raw
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatacttaaaagaggtttctttctcgtgggatgtggcatgagacaaaactgacaagtcaaggcgaggaagatgttgccatcacaactctagtttggtttctgctgtcgtcgttcggttccacgccgtacgagggtagtaaattgtgtcgtacggaccttcgtacgtccttaccgtaacgttaccgttttacgtacggttcgttacgtaacggtaaccgttaaaccggaaaacggtaaacggtaaaccgtacccaacctaactaccgtacccggtaccgggccggggtaccaacggtacgacggtacggttacggttaggtaacgttaccggtaccttaacgacgtacggtaacgacgacgaacgaacgaccgacgtacgtacctacctaaccgaacgccttcccanactaacgtagttactcgtcccttaccgtccgttccgttccggtacccggtaccgggttcccgtacggttacggtcggtaggtcggtacgtaggtcgtacgtcggtacgtactaacctaccgttaccctaccactactaacgtaactaacgtgacgtacgagtacgtagtacagttcctcgtataccttattactgtacgtatacgtagacttaacgttacctttaaccgtactaatacgtactaccttccggtaccgtaccggaaccggtaacgaaccgttagaaccgttaacggtaaacgtaacggtaacgg

SEQ ID NO: 171425 - DNA, 668 bp, Homo sapiens
  misc_feature: GYAE6OF01DO5G5.27.78.H01.1.454.CMB.1.raw
  modified_base (646)..(646): a, c, t, g, unknown or other
  misc_feature (646)..(646): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccgaaaggagaaagtcaccatccacctggccgggccagtcagagcggttggtagtagcttacactggtaccagcagaacgccaggtcagtctaccaaagcctcctcatacaagtatcgtccttcccacgttcccttcgtccgtacggggtcccctcggtacggttcaggtcggcgtacggtggactcgtgggacacgtactttccaccccgtcacctatacctaaagtacgtaccgtaggaacgtccgtagaacgtactacggtcgtaggtaaccttaaccttttaacttacgttcgtacacgttactaagtaacgttaccttaaccttttaacctacgtaaggttacgtacttaccctacccggtttacggacccggaaacgggtacccgacgtacggtaggtaaccgtaaacgttaaaccggtacgtcggttacgtacctaggtacctaaccgtnttaccgttgttcctttaacccg

SEQ ID NO: 171426 - DNA, 619 bp, Homo sapiens
  misc_feature: GYAE6OF01DK0GB.27.78.H01.1.454.CMB.1.raw
  modified_base (145)..(145): a, c, t, g, unknown or other
  misc_feature (145)..(145): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccgagggtnaattgtgctgactcagtctccagtactttcagtctgtagactacaaaggagaacgtcacactcaccgtcgccgggcagtcagngtcgttggtagtacgcttacncgttcgaacacgacacggaacgccgaggtactacgtcctaaccaaacgtcctcctacactataagtagtcgtcctccgtacttccttcgtaccgtccgggtcccgtcggtagtcgacggtgcgtaggtgacgtcgtcggactacgtacttaccacctccactactactaacgtacgtaccgtagacgtacgtagaagtcgtacgtcacgtacttaacgtttntacttcgttacacgtactaacgttacgttacctttacttaacctacgtaactcgtactaccgtacgttaccgacgtaaggacctagacgtagtaacgtaagtaacgtacggtcgtacgcgtaacgctacgtcttcgttcgtcttaccg

SEQ ID NO: 171427 - DNA, 822 bp, Homo sapiens
  misc_feature: GYAE6OF01BBZJY.27.78.H01.1.454.CMB.1.raw
  modified_base (651)..(651): a, c, t, g, unknown or other
  misc_feature (651)..(651): n is a, c, g, or t
  modified_base (677)..(677): a, c, t, g, unknown or other
  misc_feature (677)..(677): n is a, c, g, or t
  modified_base (732)..(732): a, c, t, g, unknown or other
  misc_feature (732)..(732): n is a, c, g, or t
tcagagcgtcgtctcacgaccggtgctcgatttagtgtgagtagtttgggtttggggatacttaaaagaggttctttctctgggatgtggcatgagacaaaactgacaagtcaaggcaggaagatgttgccatcaacaactcagtttgggtttctgctgcttcgtcgggttccacgccgtaccggaaggggttagtaaagttgtcgacgtggtaactccgtagttcctacctaacgttacctttccgaagttccgtggtacgtaacctaaccggaaaaaggtaagtaaaccgtaccaacccgtaactaccctaacccggttacgggaccccgggtaactaacggtacgtacggaaacggttcggttaaggttaagtaacggtaccttaacgacgttaccggtaacgagaccgaaacggaacgaccgtaacggtacacggtacccctaacgaaaccgtcctccaacgtacgaacgttaatacgtccgtaccttacccgtaacgtttccgttactaccggggacccggttcctaggtacggttgacgtcgggtaactaggtagtacgtcgtacggaacctacgtacctttaccgtacctacaaacccctagtaacaacgttacgaccgtaaggtacgacctaagacgtaagtntacgttacacgttaaactttaaccgngttactacgtaacgttaacacggtttaaaccttaaccttaaccttaaccgttaanaaacgtttcggtaaacccttctaaccgggttacaaacccggttaacgaaccggttacgaagtacgggtaaaacttaacgttaaacccggg

SEQ ID NO: 171428 - DNA, 842 bp, Homo sapiens
  misc_feature: GYAE6OF01CRK5F.27.78.H01.1.454.CMB.1.raw
  modified_base (805)..(805): a, c, t, g, unknown or other
  misc_feature (805)..(805): n is a, c, g, or t
tcagagcgtcgtctcacgaccggtgctcgatttagtgtgagtagtttgggtttgggggcatgagcaaaactgacaagtcaaggcaggaagatgttgccatcacaactcagttgggtttctgctgctctgggttccagcctccgaggggtagtaaattgtgctgactcagtctccagtactttcagtctgtcgaacctacgaaaggagaacgtcaccactcgacctcggccggaccagtcgacggaggtcggttaggtagtacgtacttacgaccgtacggtaaccgagacgaaggaacgccgtaacggtccgtaacggttcctaaccgaacgtcctaccttactaactacgtaacgtactaccgtcccgtttaccgtaccgttcctttaccgtaccgggttacccggggttaccccttaccgggttaagggtttaccggacgggtttacggaccggttaagggttacgggtaaccgttaccgggtaccggggtaaaccctttaaaccgtttaaccgttttaacccccaccccgtaaccggtaaaacccttaattaacccggtaaacgtacccgggttaccggggttaaagaaaccggttccgtaaagggtaacgaacgtttcggtaaccccgttaggtttaacccgtttaaacctttttacggtttaaccgtaacgtttacccgtaatttaccgggtaaattaaaccgtttaccctttaaccgtttaaaccgttacgtaaaccgggtactacccgttaacccgtacccgttacggaaccggtaagtacaccgtagtacggtaaanacgaacgttgagtacgctacgtccatactgtcttacg

SEQ ID NO: 171429 - DNA, 817 bp, Homo sapiens
  misc_feature: GYAE6OF01CK1NB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgaactaccgaaaggagaaaagtccaaccatccacctcggcccgggccagtcgaggagtcggttagggtagtagcttacgcgttacggaccagcgaagaacgccaggtcacgtctacaacgctcctcatacgtaagtatcgtcctcctacgttcccttacgtccggacggggttcccctaggtacggttcgaggttcggcgtaggttacggtaacgttcgggaacggtacctacgtttacctttcccgaaccccctactaaacccgtaacttaacccgtaaacgttaccgggtacccggtaagggtaaccgtacggttaaacgggtaaacgtacgttaccggttacgtacggttaaacctttaacgttttaaccgtttaacgttacgttaccctaagtaccgtaaacgtttaacctttaaccgtttaaccttttaaccctaggtaagtaccggttaaccttaccggttaacccgtaaccgggtaaccggtaacccggggtaaccgtaaccggtaaacgggttaacgggttaaacggtaaaaccgttaaaccgggtaacgttacggggccggttaaaccgttaccggaaccgttacccgttacgtttaccgtttaccggtttccccttaacccgg

SEQ ID NO: 171430 - DNA, 805 bp, Homo sapiens
  misc_feature: GYAE6OF01BENNA.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcatttgggtttctgctgcttcgttgggttccacgtccctaccgagggggtagtaaattgtgctgactcagtcctccacgtactttcagttctgtacgaacctaccgaaaaggtaacgtaaacgtaccaaccactaccaccgtcggcccggtaccgagtacgaggacgttacggttaggtagtacgtcttactacgtacgacagacgaagacgcgacggtacacgtacctaccgaacgtcctcctactataacgtaacgtacgttccgtccctttaccgtaaccgtttcccgttaccgttacccgggttacccggggttccccgttacggtaccgggttacgtagggtacggtacgtaggttacggtacgttaccgggttaacgggtaaacctttaacccgttcccctaacccgtacctaacccttacgtaaacgtaagtacccggtacggtaacgggaacgtacgtaggtaaactcggtaacgtacgttaacgtaccttaaacgttttactacgtttacgtacttacctaaggtacttaacgtttaaccctttaccgtttaaccgtaacgttacgtaccgttaacctaccgttaaccggttaccgggtaaccgaacggttaaccgtaacggttacggtaagtaaaccgtttaaggtaaacgtacggg

SEQ ID NO: 171431 - DNA, 840 bp, Homo sapiens
  misc_feature: GYAE6OF01B1EUU.27.78.H01.1.454.CMB.1.raw
  modified_base (335)..(335): a, c, t, g, unknown or other
  misc_feature (335)..(335): n is a, c, g, or t
tcagagcgtcgtctcacgaccggtgctcgatttagtgtgagtagtttgggttggggatgagcaaaactgacaagtcaaggcaggaagatgttgccatcacaactcattgggtttctgctgctctgggttccagcctccgaggggtgaaattgtgctgactcagtcctccagtactttcagtctgtgactaccgaaaggaagaaagtccaaccatccaccgtcggcccgggaccagtcgagaggtcgttgggtagtacgtcttactacgtcggtaccaggaccgagaacggccgtaagggtccgaacggtacctacccgaaacgtcctacccctanaacgttaaccgaaggtacttaccggtcccttaccccgtacgtttccccgtttccgttaccccgggtacccggggtttacccccgtaccgggttaacgggtttacccgtacgggttacgggacccgtagggttacggtacttccgggtaacgggtaacccctaagtttaacccgttttaccccaaccccctttaacaacccttaaacctaccgtaaaaccttacgggtacccgttaacgggaacggtaccgtaaggtaaacctaagggtcgtaaccgttaccgaacgttaaactttacgttaacgtcgtttaacaacggttactaacgggttaaaccttacctttaaccgtttaccgtaacgttaaggtaacctaccgtacccgttaaccggttacccggaaccgggtaacgtaacccgtaacgtaccggtaacggaaggttaaacctaaagggccggttagcgggtaactaccgtactaaccgttctactttcgtcccgtttacc

SEQ ID NO: 171432 - DNA, 808 bp, Homo sapiens
  misc_feature: GYAE6OF01C18SV.27.78.H01.1.454.CMB.1.raw
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagacaaactgacaagtcaaggcaggaagatgttgccatcacaactcagttggttctgctgctgtggttccagcctacgagggtanaagttgtgctgactcagtctccagtcttcagtctgtcgacctaccgaaaaggaacgaacgtccaaacctagtaccgacccgtacgggcccggggtaccacggttacgaagggacgttaccggttagggttaacgtacgtaccttaacgtacgtacgggtaaccacggacgaaagaacggtcctaagggtaccacgttacctaacccgaaacggtccttacccgtactaacgttaccgtaaacggttacgttccgtaacccgtttaccccgtacgtttacccctttccgttaacccgggtaccggggttacccccctgggttaaccgggttcgtaacggtcgggtaacgtacggttaggtacgttacgggttacgggaaccttaaccttacctttaacccctaccctaccctaacctaactaaccgtaacgtaccggtacccgtaaggtaacgtactaacggtaacgtacgtacggtctaacgtaaaccgttaacttttaacgtacgttacgttaacacgttacgaacgttacgttaacctttaacgttaccctagttaacgtactaccgttaccgtacccgttaccgaacgaacggtactaacggagtaacggaagtaaacttaaaccgg

SEQ ID NO: 171433 - DNA, 742 bp, Homo sapiens
  misc_feature: GYAE6OF01ADQNH.27.78.H01.1.454.CMB.1.raw
  modified_base (339)..(339): a, c, t, g, unknown or other
  misc_feature (339)..(339): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgagggtgaattgtgctgactcacgtctccagtactttcagtctgtcgactaccgaaaggagaaacgtcaccactcaccgtcggccgggccagtcagaggtcgttggtagtacgtcttacacgtacggtaaccacgacaaggacgccgtaggtacgtacgtaccgtaccaaacgtcctaccctcgtactacgaacgttntaccgtcccgttcccgtagttcccttcgtaccgtaccggttcccgtcggtagttccgaggtcggcagggtacgtacgttcggtaggtaacctacctacgtttacccacccgtactaacctaagtacctaacggtacgtcgtaaggaacgtcgtaacgacgtagtactacgtacgtacctaacgtttactacgtacggtactacgttaacgtacggtaacctttaacgtttaaccttaaccgttacgttaacggtcgttaacccttaacctacccgggtttaccggaaacccggtaacgggtacggtaaccccggaagggttaccgtaagggttaaacttaaaacggtcgggttacgttaccggtccggttaacacctaaccgttcgttaccttccggtttacc

SEQ ID NO: 171434 - DNA, 883 bp, Homo sapiens
  misc_feature: GYAE6OF01BOLW7.27.78.H01.1.454.CMB.1.raw
  modified_base (326)..(326): a, c, t, g, unknown or other
  misc_feature (326)..(326): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtagaaattgtgctgactcagtcctacagtactttcagtctgtacgacctacgaaaggagaaacgtcaccgatccaccgtcggaccggaccaggtcagagtcggttaggtagtagtacttacgacgtacgtaccgacgacaaggaacnccgtacggtacacgtacctaaccgaaacgtccttacctacacttaacgtaacgttacgtaccgtcccttacccgtacgttacccctttccggtacccggtaccggggttcccccgttacggttacggtttaccgtacgggttacgggtaccgtaggttaccggtagttacccggtacgggtaacccgtacctttaacctttaccccgaaccccttaaccctaacccctaattaaccgtaaagttacccggaaccgttacgggtaaaaccgtcgtaacggtaaagtacgttaccgggtaaccgtaccgtttaaaccgtttaaacgtttttaaccgttaccggtttaaccgtaccgttaaacgtaaccgttaacgggtttaacctttaaacccccgttttaaacgttttaacccgtttaaaccggaaggtttaacccgttaacccgttacccggttttaaacccccggtttacccgggaaaccggtaaaacccggggtaacccaaccgggtttaaacccggtggggtaaaaaaccgtttaaacccggttaaaaaccggg

SEQ ID NO: 171435 - DNA, 811 bp, Homo sapiens
  misc_feature: GYAE6OF01BM9K9.27.78.H01.1.454.CMB.1.raw
  modified_base (310)..(310): a, c, t, g, unknown or other
  misc_feature (310)..(310): n is a, c, g, or t
  modified_base (404)..(404): a, c, t, g, unknown or other
  misc_feature (404)..(404): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaattgtgctgactcagtctccagtactttcagtctgtgactaccgaaaggacgaaacgtccaccatccaccgtgcccgggacagtcaggacgtcgttggtacgtagtcttacaccgtggtaccagcagaacgccaggtccagtcctaccaaagtcctcccgtnaactacaagttactcgtcctttcccacgttccctttaccgtccggtacgggttcccctcggtaacggttcgaggtcggcgtggtacgacgtcgngggtaccacgttactttccacccctcgaaccctatacgaaacgtacgccgtaaggagtaccgtaggtaacgtaagtccgtatacggttaactaaaccgtttacgtttaagtacgttaccgtacgtaaccgtaacgtacgtttaacccgtttaacctttaaccgttaaccgtaaacgttacggtaacctttaacccggttaccccggtttaacggggaacccccggtaaaagggtaccccgtaaacccgggttaacgggttaaacccgggaaacggtttaaaacccgggtttaaaaccggttaaccggggttacgggtttaccgggtaccccgggtttaaaccgtaccccgggttaacccttaaccggtttaacccggtttcccggtttaccccttttaaccccgggg

SEQ ID NO: 171436 - DNA, 621 bp, Homo sapiens
  misc_feature: GYAE6OF01E1PR2.27.78.H01.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaattgngctgactcagtctccagtactttcagtctgtgactaccaaagganaaacgtcaccatccaccgtgcccggcagtcagagtcgttggtagtagtctacactggtaccagcagaagccgaggtcagtctaccaaagcctcctcactacaagtactcgtcctaccgacgtccttcgtcgtaccgggtccctggtacggttcagtcggctaggtgtactcgtacggacactacgtttccaccgtcaacctactacaatacgaccgtaggaacgcgtagtaagacgtcgcgtacgtactaacttacgttacgtacgttctaacgtccaagttaccgttaaccgtttaacctttaccgtagtaacgtcgtaccttaccgtaccgttaccgggaaccgtaaacgggacctaaccggaacttacgggaacgtaacgttaaaccgg

SEQ ID NO: 171437 - DNA, 719 bp, Homo sapiens
  misc_feature: GYAE6OF01AQIIQ.27.78.H01.1.454.CMB.1.raw
  modified_base (183)..(183): a, c, t, g, unknown or other
  misc_feature (183)..(183): n is a, c, g, or t
  modified_base (534)..(534): a, c, t, g, unknown or other
  misc_feature (534)..(534): n is a, c, g, or t
  modified_base (690)..(690): a, c, t, g, unknown or other
  misc_feature (690)..(690): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcatttgggtttctgctgctctgggttccagcctccgaggggtanaaattgtgctgactcacgtcctccagtactttcgacgttctgtacgacctaccgaaaagggtacgaaacgtccaaccatcccaccgtacgggcccggaccacgtacgaacggagtcggttaggtagtagtaccttactacgtacggtaaccagacaacggaacgaccgaggtcaacgtcctaccaaacgtccttacctacacgtactaaagttctcgtaccttaccgtaccgttccttacccgtaccggtacccggggttccccgtaggtacggttcgtagggttccggacgttacggtcgtacgtcgttaacgggcctaacgtactttacccgacccctacaacccttanacctaagtaccgtaccgtaggaacgtcgtagtaagcgttacgaccgtactaaccctttaactttacgttactacggtactactacgtaagtaccttacttaccgttaactacgtacggttactacccttacgtcccgtaccggacgtaaccggtanaccgtacggtacgtaagtaacggttaacg

SEQ ID NO: 171438 - DNA, 736 bp, Homo sapiens
  misc_feature: GYAE6OF01AE2VX.27.78.H01.1.454.CMB.1.raw
  modified_base (273)..(273): a, c, t, g, unknown or other
  misc_feature (273)..(273): n is a, c, g, or t
tcagagcgtcgtctcacgaccggtgctcgatttagtgtgagtagtttgggtttggggatgagcaaaactcgacaagtcaaggcagaagatgttgcatcacaactcattgggttactgactgctcgtgggttaccgagtccgtccgaggggtagtaaatttggttgtctgacttacgtaagtcctccagtactttcaggtctgtgactacgaaaggagtaacgtcgacatcaccgtgccgggcgagtcgagacgtcgttaggacgtatactacncgtcggtaaccagtacagaacgcgtaggtcgtacgtctacgaacgtcctaccgtctacgtaccgtaggtactccgtaccgttacccgtacgttaccgttacgtaccggtccgggttcccctacgggttacggttaccgtaggtacgtacggtaggtacgggtaactacggtacggtaaccgttacttacctttaccgaaccccttaccaacccgtaagtaacgtaaacgttacgaccgtaaggtaacgacgttaacgaagtcgtacggtactacgtaccttaaattcttaacgtcgtactactacgtaacgtacttaacctttacgttaacgtagtaacgtttacgactaccgttacggaccgaacggtaccggtaaccaggttaaacgtacggtaaagtaaccggtttaaagcggtacgtacggtactggtaaccctagtaccgtcggttactccgttaccg

SEQ ID NO: 171439 - DNA, 777 bp, Homo sapiens
  misc_feature: GYAE6OF01DX02O.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcacttcgggtttcctgctgctctgggttccagccgtccaggggtgaaagttgtgctgactcagtctccagtactttcagtctgtgactaccaaaggagaaagtcacactcaccgtcggccgggccagtcagacggtcgttaggtagtagcttacacgtacggtaccagacaagaacgcctaggtcagtacctaccaaagcctcctacactacgtaagtactcgtcccgtttaccctacgttcctttaccgtaccgggtacccgggggttccccgtacggtaacgggtttcgtagggtacgggccgtagggtcggtacgtaccggtacgggtacctaacgttacctttacccaccccttcaacccacttacgaaacgtaccgtaccggtaaggaaccggtacgtacggaaaacgtgtcgaacgttacggaacctttaacgtttacttaccgttactacgtaacttaccgtaaggttaaccttttaacctttaacccgtttaacctacgttaacgtccgttaacttacccggtacccggttaccgggaacccggtaaaccggggaaccacgggttaacgtaacgggttaaacgttaaacgttaaaaccggtaacggtttacggtacgggttacctaccggtaccttacccttagttaccgtttgttacccc

SEQ ID NO: 171440 - DNA, 667 bp, Homo sapiens
  misc_feature: GYAE6OF01COF8F.27.78.H01.1.454.CMB.1.raw
  modified_base (440)..(440): a, c, t, g, unknown or other
  misc_feature (440)..(440): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtacttcagtctgtgactaccaaaggagaaagtcaccatccacctgccggccagtcagagtcgttggtagtacgcttacactggtaccagacaagaacgcaggtcagtctaccaaagcctcctcatacaagtactcgtcctcccacgttccctttcgtcggaccgggttcccctcggtaggttccgaggtggccgtaggtggagttcgacgggactacgtacttaccaccctcaccaactacgaatacgccgtaggaacgtcgtagaagtntacggtctacgtaacttaacctttatacttcgtactaactcaaggtacttaacctttactttaacccgtagttaacgtacgtactacccgttacccgttaaccgggacccgtaaagggtaccgtaacggtacgttaagggtaaacgttaaaccgttaaacggaacccggtttggaacggttactaccgacccgtaacctacgtttaccgttacgttccctttaaccc

SEQ ID NO: 171441 - DNA, 798 bp, Homo sapiens
  misc_feature: GYAE6OF01CE3UE.27.78.H01.1.454.CMB.1.raw
tcagagcgtcgtctcacgaccggtgctcgatttagtgtgagtagtttgggtttggggatacttaaaagaggttctttctctgggatgtggcatgagacaaaactgacaagtcaaggcaggaagatgttgccatcaacaactctagtttgggtttctgctgctcgtcgggttccagtcccgtaccggaggggtagtaaagttggtcgtctcgaacctcacgtcctacctagttactttcgagtcgtgtacgtaactaccgaaaggtacgaaacgtccaccactccaccgccggaccggtaccgagtaccgaggtacggtacggttagggtaacgtacggtaccttaaccgtaccgttaggtacccagacgaacggaacgtaccgtacggtactaacgtacctaaccgaactcctacctactaacgtactaagtctccgtccttaccgtacgttccttacggtaccgggtcccggtccgtacggttacgtcggtacgtcgacgtaggtacgacgtcggtacggacctacgttcctaccgtaccctactaaccgtaagtacaaaccggtcgtacccggaaggtaactaccgtagggtaaactcggtaacgtcccggttaataccctttaaacgtttaccccgttagtacccgttaacttaacgtaccggttaaacggttaaaccctttaacctttaaccgtttaacccgaaagttaacgtacgtacctacccggtaaacggtcccggaaaccggtaacggtaaccgtacgtaacgtacggtaaagttaaccgttaaacggg

SEQ ID NO: 171442 - DNA, 782 bp, Homo sapiens
  misc_feature: GYAE6OF01BCM9K.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctcagtacctttcagtctgtacgactaccgaaaaggacgtaaacgtccaaccactccaccgtcggccgggtaccagtcacgacgtcggttaggtagtagtcttaacgactacggtaccagacagaacgccgaggtcacgtacctaccgaaacgtcctcctactactacgtaacgttactcggtacccttccctacgttcccctttcgtacccggtacccggggttaccccgtacggtacgggtttaccgacgggttcgggaccgtaggtcgggtacgttcgggtaacggggaacctaccgttaccttttacccgaacccccttaccctaaccctaccgttaccaaacgttaccgacccggtaacgggtaacgtacgtaacggtaagtacgtcgggtctaacgttaaccgttaaccttttaacgttaacgttcttactaacgtacgtaacgttaacgttaaccctttaaaccgtttacctaacgtaacgttctaaccgttaccgttacccggtaacccgggaacccgaaacgggtaacccgaaccggtaacggtaacggtaaacgttaaacggttaaaacccggg

SEQ ID NO: 171443 - DNA, 874 bp, Homo sapiens
  misc_feature: GYAE6OF01DAZ0S.27.78.H01.1.454.CMB.1.raw
  modified_base (236)..(236): a, c, t, g, unknown or other
  misc_feature (236)..(236): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtagaattgtgctgactcagtctccagtactttcagtctgtcgactaccgaaaggagaacgtcaccatccaccgtcggccggcacgtacgagngtcgttggtagtagactacacgtacggtacacgacgaagacgacgtacggtacacgtacctaccgaacgtcctacctactactacgtaagtacgttcgtccttcccgtacgttcctttccgtccggtaccgggttaccccgtacggtacggttacgtaggtacggtacgtacggttggacgttcggtacgggtaacctaaccgttacgtttacccctaacccgttacctaacctaacgtacctaaaacgttaccggtacccggtaagggtaaccgtacggttaacggtaacggtaacgttacggttaccgttaacgtaaccccgtttaaattttaaccgtttaaccgtttcgtaaccgtaacgtttaccggttaaacggtttaacccgtttaaaccctttttaacccgttttaaacccgtaacggtttaaacgttaaccgttaaccgtttaccccgttacccggggtttaacccggaaacccggggttaacccgggtaaacccgtaaccggggtaaccgttaaacggggtaaacccgttaaaacgggttaaacccggtaacggtttccgggtaacggttaccgaacccgttaacctaaccggtttacctttacgtcccgtttacccttttaaccccgg

SEQ ID NO: 171444 - DNA, 905 bp, Homo sapiens
  misc_feature: GYAE6OF01CIZ34.27.78.H01.1.454.CMB.1.raw
tcagagcgtcgtctcacgaccggtgctcgatttagtgtgagtagtttgggtttggggatcgttaaaagaggttctttctctgggatgtggcatgagcaaaactgacaagtcaaggcaggaagatgttgccatcacaactcagttgggttctgctgctcgtcgggttccagcctccgaggggtataaagttgtgctcgactcgacgtctccgagtactttcacgtctgtagactaccgaaaggagaacgtccaacctactaccgaccgtacggcccggtaccgtacgtacgaacggtacggttaccggtttaagggtaaacgttacggttacctttaaaccgtaccgttaacgggttaaccctaacggtcgaaacgggtaaccggtacccgtaacggttaccggtaacgtttacccgtacccggtaaaacggtcccttttaccgacgtaacgttacgtaaacgttctaaccgtcctttacccgtacgttcccgttaccgtccgggtaacccgggtttccccgtaggtaccgggttaacgtacggtcggtaacgtcgggttaacgacggtaccggtttacgggaaccttaacgttacccgttttaccccaaccgttaccgaaaccttacgttaacgtaaacggtaccgtacccgttaagggaaccgttacgtaaggtaacgtaccgttacggtaacgtttacccgaaacgttttaacgtttaccgttaacgttaccggttaaccttaacggtacccggttaagtaaacccgtttaccttttaaaccggttaacccgttaagtaaccggtacgtttacccgttacccgttaacccgggttacggaaacccggttaacggaaccgtaaccggttacgaacgggttaaaacctaaccggtttaaaaccgg

SEQ ID NO: 171445 - DNA, 749 bp, Homo sapiens
  misc_feature: GYAE6OF01BHVY5.27.78.H01.1.454.CMB.1.raw
tcagagcgtcgtctcacgaccggtgctcgatttagtgtgagtagtttggggtttggggatgagcaaaactgacaagtcaaggcaggaagatgttgccatcacaactcattgggtttctgctgctctgggttccagcctccaggggtgaaattgtgctgactcagtctcacgtactttcagtctgtgactaccaaaggagaaagtcaccatccacctgccgggccagtcagagcgttaggtagtagtcttactactggtaccagctagaacgccaggacacgtcctaccaaagcctccctactatacctaagttatcgtccttacccacgttacccttccgtaccgtaccggggttcccccttacggtaacggtttccaggttcggcgtaggtggtactccggtagggacctacgtactttacccaccccttaccaacctactaacctaacgttacggcccgtaagggaacgtctacggaagtacgttcgacgtaggtaacccttaaacgttttacgttaacctttaggttaccctaacggttactaacggtaccgttttaaacttaacccgttttaacctaacgttaaacggttcgtaaccgtttaccgtaaccccggtttccgggaacccgtaaacggggacctaaccggtaaacggtacgggtaaaccgtaaagtttaaaccggaccgttagggtaccgaccgttcggaacccttacgtacccgttacgttccgttacctttacccg

SEQ ID NO: 171446 - DNA, 706 bp, Homo sapiens
  misc_feature: GYAE6OF01B41SH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctccgagggtgaaattgtgctgactcagtcctccagtactttcagtctgtagacctacgaaaggaagaaacgtcaccatccaccgtcggccggccagtcaggagtcgttaggtagtagtccttacacgtacggtaccagtacgaaggaacgccgaggtccacgtacctaccgaaacgtcctcctactaatacgtaagtactcgtaccttaccctacgttccttacgtaccggtacccggggtcccctcggtacggttcgacggtcggacgtacggtcggtacgttcggacgggtaacctacgtttaacctttacccgaccccttacccaacccgtactaacctaaacgtacgtcccgttaaggaacgtccggtaagaaccggtagtcggtaccttaaggtacccttaaacgtttacttacgttagtactaacgtactaacggttaacttacctttaaaccttcctaacgtagttactacttacccgtacgttacccggaacgtaacggactacgtaagaggaaacgttaagtaaaccgg

SEQ ID NO: 171447 - DNA, 618 bp, Homo sapiens
  misc_feature: GYAE6OF01EHY48.27.78.H01.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtnaaattgtgctgactcagtctccagactttcagtctgtgactccaaaggnaaagtcaccatcacctgccggcagtcagagcgtttggagtagctttacactggtaccagcagaagccaggtcagtctccaaagctccncatcaagtatgacttcccgagtcctactccagggtccccctgtaggttcaagtcggcagtgggaatcgtgggacactaactttcacccctcaacccattaccaattaacgccctagggaagccttaagaagattggcctaggtacctaaacgttatttaaccgtgtttaaccattaccgaagtacgttaactttaaccctttactaccgtaaaagttccggaattacccgtaaccgtttccgggaccctaaggggaacctaacggaccgtggaagtaacttaaaacccgaaagtcggtagggacttacggacctaaccatttaccttgtcttaacc

SEQ ID NO: 171448 - DNA, 774 bp, Homo sapiens
  misc_feature: GYAE6OF01DDA43.27.78.H01.1.454.CMB.1.raw
  modified_base (516)..(516): a, c, t, g, unknown or other
  misc_feature (516)..(516): n is a, c, g, or t
  modified_base (562)..(562): a, c, t, g, unknown or other
  misc_feature (562)..(562): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagccccgtagggaggtaattagttggtcgtcgtactacctacgtacgtcctacgtactttaccttacgtcgtcgtcgtactaccgtaaacggaaaggaacgtaacgtaccaacctacgacccgtaccggccgggcccgtacgtacgtacgaaacggtcggtttagggttaacggttagtaccggttacctaacgtcggttacgacgacacggaacgaccgtcggtacgtactcgtaacctaaacgcctccttacgactacgtaacgttactgtcccttaccctcggttacctttccgttacggccgggttaaccccgttccgtacgggttctacggtacggtcgtaagtcggtagttcgtacgggactacctattccctacccncctaccgtacaactagttaaccgccttaggacagtacgaagacgtntacgtacgacttaaaccttagttaactctaacgtactacgttacgtacgttaccttaaccttttacctactaacgttactacgttaccgtacccgtacggtaaccgacgggtaacgtaaccgtaccgtagggttaactaaaccggttaaacgtaacggttcggttcgaacgtcctaaccgacgtaccttcgtttacccgtcttacttacccg

SEQ ID NO: 171449 - DNA, 849 bp, Homo sapiens
  misc_feature: GYAE6OF01CZBJB.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctcgaggggtanaaattgtgctgactcgagtcctacctaggtacttttcgagttccgtgtacgtaaccgtaccgaaaaagggtaacgaaaacgttaccaacccgtaactcccgtaaccgtccgggacccggggtacccgaacggttaccgaagggtaacggttaccgggtttagggttaacgttaacggtaccgtttaaccgtaaccggttacggttaaacccgaacgggtaacgaaacgggtaaacggaccccggtaaggggttaccctaacggtttacccgtaacccgaaaaccgtccttaccccgtaatactacgtaaacgttactcgtcccttacccgtacgttcccgtttaccggtaccggacccgggtttaccccgtacgggttacggttaaccggtacgggttcgggtaccgaagggttacggtaccgttacggtacgggtaaccgttacctttaaccttaccgacccctaacgtaaccctacgtaacctaacggttacgtaccgtaacggtactacgtaacgtaggtactcgtacgtactacgttaacttacgttagtacgtacacgttacgtacgttacgtaaactttacgtaaccttagacgtcgtaacctccgtaaccggttcgaaaccggtacgtaacgtacggtagtaaacgagttaaacgtaaacg

SEQ ID NO: 171450 - DNA, 868 bp, Homo sapiens
  misc_feature: GYAE6OF01AR7UN.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcacaactcagttgggtttctgctgctcgtgggttccagcctcgaggggttagtaacttggtgactgtacctcgtacgtcctccgtattacctttcacgttccttggtcgaaccgtaacgaaagggaacgtaaacgtccaacctactaccgtaccggtccgggccgggacctaaggttaccgaagggtaccggttacgggtttacggggttaacgttaccggtacctttaacgtaccggttaaccggtaaccgacgaacgaacggtaacggtacccgaaggttacctacggtaaccctaccgtaaacgtcccttacctactacgtaacgtaacgttactccgtaccttacccgtactttcccgttaccggtacccgggttaccccgggttaccccgttagggttaccggttcgtaacgggtccggagttacgggtgttaacggtcggtacggtacctacgttaaccttcccgtaccctaaccgacttaacgtacgtaacgtacggtaccggacggtaatcggtacggaatcgtacggtacctacgttactttaacttacgttaccttcgtatacgttaacgtactttaaccgtttaccctttaaaccgtttcgaaaccgttacggtttacctacccggttaaccctttaaccgggaccggtaacggtaaccgggaacgtaacgttaacgggaaccgttaaagtaaccgttaccggtaacgtgggtaacctctacgaccttacgttactttcgtaccctttcgtaaccccg

SEQ ID NO: 171451 - DNA, 638 bp, Homo sapiens
  misc_feature: GYAE6OF01ATI0X.27.78.H01.1.454.CMB.1.raw
  modified_base (151)..(151): a, c, t, g, unknown or other
  misc_feature (151)..(151): n is a, c, g, or t
  modified_base (268)..(268): a, c, t, g, unknown or other
  misc_feature (268)..(268): n is a, c, g, or t
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (583)..(583): a, c, t, g, unknown or other
  misc_feature (583)..(583): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtanaaattgtgctgactcagtcctccagtactttcagtctgtcactacgaaaggagaaacgtcaccatccacctcggccgggccagtcagacgtcgttggtagtcgtcttacactgtacngacgagacgcgagtcagtcctaccaacgtcctcctacatactaaagtntacctccttcccgactcccgttcnccggtaccgggttccccnggtacgttcgaggtcggacgcgtggtctcggtacggactacttcttacccgtaccctactacctatacacgttcgccgtaagagtcgtagacgatgcacgtactacgtttactgtacgtctagtacgtatacgttaaccttaccgttacacgtatacgtacctacggtacccgtaccggaacgtaccggactacggtacgtaaggtaaacgttaaggtaaacccnggttcggtaaccgtcgtacccggaaccttaacgtccgtttcgtaccgtttaaccg

SEQ ID NO: 171452 - DNA, 789 bp, Homo sapiens
  misc_feature: GYAE6OF01E38O5.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggtccagcctccgaggggtgaaattgtgctgactcagtctccagtactttcagtctgtgactaccgaaaggagaagtccaccatccacctcggccggaccagtcgagagtcgttggtagtacgtccttacacgttacggtaccgagacgaacggaaccgaccgtaggtactacggtacctaaccgaaacggtcccttacctactaacttacgaacggttacgttccgtaccctttcccgtaccgtttccctttcgtacccggttacccggggttcccccttacgggttacggtttaccgagggtcggtaccggtacggtggaacgttacgggtcggtaaccgtaccctttactttacccaaccctacccgtactacttacgaagtttaccggtacgtacgggaacgtaccgtaagaagtactacggtacctagttaaccttaacgttacttacgttcgtactacgtagtaacggttaaccttaccgttaaccgtttaccgaacgtaagttccgtaaccgtttacccgaccggtttaccgggacccgaacggggtaaccgtaccgggtaaggtaaccggtaaaacggtttaaccgttaaacggttaacggtggtacggtacctacgtaacccgtacttaccgttcgttacgttccctttacccg

SEQ ID NO: 171453 - DNA, 869 bp, Homo sapiens
  misc_feature: GYAE6OF01CDBD6.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctcgttcgggttccagtccctccgaggggtagtaaattgtgctgactcacgtctccagtacttcagtctgtanactacgaaaggagaagtacacctatccaccgtcggcccggccacgtcgaggagtcggtttggtaagtacgtacttacgacgttacggtaccacggacaggaacgccgtaggtcacgtccgtaaccgaacgccttacctacgaacttacgaaagttactccgtacccttcccctacgtttcccgttccggtaccggttacccggggttccccgttaccgggtaacggtttacgtacggggttacggtacgtacgggttcggtacgttacccggttacgggtaacccttaacgtttaccctttacccctacccccttaccgaaacccccttaacgtaacctaaacgttaccggtcccgtaaacgggtaaacgccgttaaaggaacgtacgttacggtaccttacggttaaacccgtttaacttttaacccgtttaaccgttaccggttacttaaaccgttaccggtaacgttaaaccgtttttaccctttaaacccgttttacccgtaaaccgtttaaacgggttacccttaaccggttacccccggttaacccgggtttaaccccgggaaccggtaaacccgggtaacccggttaaccggtaaacggttacgggtaaaacgttaaacccggtttaaaaccgg

SEQ ID NO: 171454 - DNA, 688 bp, Homo sapiens
  misc_feature: GYAE6OF01CIDLU.27.78.H01.1.454.CMB.1.raw
  modified_base (198)..(198): a, c, t, g, unknown or other
  misc_feature (198)..(198): n is a, c, g, or t
  modified_base (487)..(487): a, c, t, g, unknown or other
  misc_feature (487)..(487): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtggttccagcctccgagggtgaattgtgctgactcagtctccagtactttcagtctcgtgactacgaaagganaaacgtcaccactcaccgtcggccggtccagtcgagtacgtcggttggtagtatctacacgtacgtacagacaagaacgccgtaggtacctacgtcctaaccgtaacgtcctccgtactactacgtaagttactcgtccttacccgacgtttccctttcgtccggtaccgggtccccgtggtacgttacggaggtcggacgtaggtcgacgtcggtacggactaccgtaccttaccaccgtaccactactaacctaagtacgaccggtagaacgacgttaagaacgttntacgtactacgtaactttactttacttaacgttcgtacctagtactagttaccttaccttaacttacctaggtaactacgtacgttacccttaccgtaccgggacgtaacggtactaccggacgtaaggtaacggttaaacgtaacgtacggttcggtacgtacgttacgaccacctttagtaccttcggttccttacccg

SEQ ID NO: 171455 - DNA, 666 bp, Homo sapiens
  misc_feature: GYAE6OF01B4RIJ.27.78.H01.1.454.CMB.1.raw
  modified_base (502)..(502): a, c, t, g, unknown or other
  misc_feature (502)..(502): n is a, c, g, or t
  modified_base (657)..(657): a, c, t, g, unknown or other
  misc_feature (657)..(657): n is a, c, g, or t
tcagagcgtcgtctcacgaccggtgctcgatttagtgtgagtagtttgggtttgggatgagcaaaactgacaagtcaaggcaggaagatgttgccatcaacactcattggtttctgctgctctgggttccacgcctccgagggtgtaaattgtgctgactcagtctaccagtactttcagtctgtcacctacgaaaggagaacgtcacccatccgaccgtcgaccggaccgagtacgagaggtcggttaggtaagtacgtaccttacgtagtaccggtaccagacgaagacgcgtaaggtcgtacgtactaccgaacgtccttaccataacgtaaagttactacgtccttaccctacgttcccttacgtccggtaaccgggtccccgtgtacggttcaggtcgagtagtacgagtcgtacgactacctcttaccacctccactatacaagtacgtacgagtaacgtatacgagtacgtcgacctagtaacctaacgttttanaccgtacgtaactagtacgaacgttaacgttaacccgtttacctttaacgacgtaagttcaccgttacctaacccgttccgggacaacgggtaacctagtaacgtacggtaaagaacgttaacgaacgttgcgtacgtcgactacgtataccgtnttctcttac

SEQ ID NO: 171456 - DNA, 739 bp, Homo sapiens
  misc_feature: GYAE6OF01EW12Q.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaaggcaggaagatgttgccatcacaactcattgggtttctgctgctctgggttccagcctccgaggggtgaaattgtgctgactcagtctccagactttcagtctgtgactccgaaaggagaaagtccaccactcaccgtcgccgggccagtcgagaggtcgttggtagtacgtcttaacactggtaccagcgagagccgaggtcagtctaccaacgcctcctcactcaacttatcgtaccttccctaacgttccgttccgtcgaccgggggttcccctcggtacggtttacgaggtcgggcgtaggtacggagttccggtagggacccttaacctactttacccgaacccccttctaacccctaactacgtaaacgttaccggtaccgtagggtaaacgcgttaacggaacgtaagtcgtccgtaagtaccgttaaactttaccgtttacgttaacgtccgttaactaccgttaacgttaaccggttaacccttttaaccctttaaccctaacggttaaacgtttaccggtaacctttaccgtaacccgtttaccccgggaaccgtaaaccggggaacttacccgggtaacggtttacggggaaaataaccgggtttaaaaacccgg

SEQ ID NO: 171457 - DNA, 910 bp, Homo sapiens
  misc_feature: GYAE6OF01E5M1Z.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaaggagaaacgtcaccatccaccgtcggcccgggccagtcagaggtcgttagggtagtacgtcttacgacgtacggtaccagcgaagaacgccgaggtcgagtacctaccgaaacgtcctcctacactacgtaagtactcgtccttacccgtacgttccttccgtccggtaccgggttccccgtcggtacggttcgaggtcggacgtacggtaggtacgttcggtacgggaactaacgttactttacccgacccttaccgaacctaactaccgtaaacggttaacggacccggttaagggaaccggtacgttaagggaaacgtacgttacggtacctttaacggtaaccctttaaaccgtttttaacgttttaaaccgtcggtttaaacccgtaacgtttaacccggtaacggtttaaaccgtttttaaccccgtttaaaccctttttaaccccgtaacgtaaacgggtttccggtaaacccttacccggtttaaaccccgggttacccgggtaaacccggtaaaacccggggtaacccggtaacccggttaaaccgggttaaacgggtaaaaaccgttaaaccggttttaaaaaacccggggaacccggttttcgggggttaacccggttacccgttaaccccgggtaacccctaaacccgttttaaaccgtttcccccggttttaaaccgttttaccccgttttaacccccggg

SEQ ID NO: 171458 - DNA, 907 bp, Homo sapiens
  misc_feature: GYAE6OF01BUIX2.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccacgcctccgaggggtagtaaattgtgctgactcgagtctccagtactttcgagtcgtgtacgtacctaccgaaaggagaaacgtacaccgactccaccgtcggcccgggacctacgacaggacggtccggtttggtagtacgtccttaacacgtcggtaccagtacgaagaacggtccgacggtctacggtcctaccgaaacgtccctacctactactaacgtaacgttaattcgtcccgtttacccgtacgttccccgtttccgtacccgggtaccccgggggttacccccgttacgggtaccgggtttaccggaacgggtttcgggtaccggttaaacgggtttcggggtaacgtttacccgggttaccgggggtaaacccctttaaccgtttacccggttttaaccccctaaccccccggtttaccctaaacccccgttaaacgttaaaccttaaaaccccggtttaaccgggtacccggtttaaaagggggtaaacccgttaccggttaaacgtaaacgggtttaacgtttaccggtaccgttaaacggtacccttttaaaccgtttaacgtttaaccggttacgtttacctaaacgtaccgtaacgttaacggttaaccctttaaccgtttaaccgtaaccgtacgttaccgtaccttaccggtcccggttaacgtaacccgggaaggtacccccgaagttaaaccgggtaggtaaacgtttaaacgttaaaccggg

SEQ ID NO: 171459 - DNA, 1125 bp, Homo sapiens
  misc_feature: GYAE6OF01ATUGN.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctcgtgggttccagtcctccgaggggtnaaattgtgctgactcagtctccgagtactttcagttctgtgacctaccgaaaaggacgtaaacgtcaccacttaccaccgtcggcccgggacacgtcgagacgtcggttaggtagtacgtacttacacgttacggtaccaggtacacggaacgaccggtaggtacgacgttacctaacccgtaaaaggtcccttaccctacgtaacgttaaccgtaacggttaacttcccgttacccgtttaacccccgttagttttcccccgtttacggtttaccccggggtacccggggtttaccccccgttacgggtttaacccgggtttacggtaaccggggttaccggggtacgttacggggttaaaccgggttaccgtttaccgggttaccgggggtaaccctttaaccggttttaacccccgttttaccccggtaaacccccctttacccggtaaaaccccgttaaccgttaaacccgtaacgggtttaacccggtaacccgggttaaacggggttaacggtaacccggtttaaacggggtaaacgttacccgggttaacggttacccggtttaaacccggttaaacgttttaaaacccggtttttaacccggttttaaaccccgttttaccggtttaacgtttaaacccccgggtaacgttaaaaaccgggttttacccgtttaaaacccccgggtttttaaacccctttttaaaccccggtaaaaccggtttttaaaaccgggtttcccgttttaaaaacccccggttcccccgggtttttaaaccccccggggtaacccgggggtttaaaaaccccccccggggttaaaaccgggggtttaaaccccgggttaaaaccccccggggttaaaccgggttttaaaaccgggggttaaacccgggttttaaaaaaacgggttttttaaaaaaccccccccggggggg

SEQ ID NO: 171460 - DNA, 1025 bp, Homo sapiens
  misc_feature: GYAE6OF01CWO8D.27.78.H01.1.454.CMB.1.raw
tcagagcgtcgtctcacgaccggtgctcgatttagtgtgagtagtttgggtttgggatacttaaaagagttctttctctgggatgtggcatgagacaaaactgaacaagtcaaggcaggaagatgttcgccatcaacaactctagttgggtttctgctgcttcgtcggttccagcctacggaggggtataaattggtgctagtactcgacgttcctaccgtaagtacctttcgaggttcttaggtacaaccgtaacccggaaaaagggtaaacgtaaaaccggttcccaaccgaaccgttaccctaccccggtacgggggaccccggtacccgtaaacggtacgtaacggtaaccgggtttacgggttttagggtaaaacggttaccggtaccctttaaccgtacccgggttaaccggttaaacccgaacggtaaccggaaaacggaaaccgggtccggttaaacgggtccgtaacccggtttaacccaaacccggtaaaacgtcccttaccaacctaacttaaccggtaaatcgttaccccgttaccgttacccgttaaccgtttccccgtttaacccgttcccggggaaccccggggtttcccccggttacgggttaaccgggtttaccggtaacgggtcgggtaaccgtaaggggtcgttaaacgggttccgttaacgggaaccctttaaccttacctttaacccccgtaaccccgtaacctacccttaaacgtaccgttaaaaccgtcgggttaacgtagggtaaaccgtacgaaacgtaacgtaacggttaccgaccgtttaaccggtaacctttttaaaccggtttacttacggttataaccgtaacgttaacgttaaccggttaaccctttttaacctaaaacccgttttaccacggtttaaacgttacccggttaaccccgttacccggttaacccgtttaaccccgggaaaccggtaaacggttacccgaaccggttaaacgtaaacggtaaaacgttaaaacccggtttaaacgg

SEQ ID NO: 171461 - DNA, 837 bp, Homo sapiens
  misc_feature: GYAE6OF01E0NK8.27.78.H01.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (237)..(237): a, c, t, g, unknown or other
  misc_feature (237)..(237): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctaccaggggtnaaattgngctgactcagtctaccagtactttcgagtctgtgacctaccgaaaagganaaacgtcaccatccaccgtgccggcagtcgagagcgttggtaagtagtcttacactaggtacccagactaggaagcccgagggttccacggtcctaaccgaaacgtccctaccgtacaattacgaaagttactcgtccctttacccaagtttcccctttacgtccggtaaccggggtttccccctaggttacgggttacaaggtttcgggaccgtagggttcggtacgttccggtacggggtaacctaaccgttaccttttaccccgaaccccgtttacccgaacccttaacgttaaccgtaaacgttaacccggtacccggttaagggaacgttaccgttaagggtaaaccggtgttacccggtaccgttacgtaacccggtttaaaccttttacgttaacccgttacgttaccgtaacgtttaccgaaacggttaccgtttaaaccttttacccgttttaaacccgtaacgttaaacggtttaacgtaacccgttacccggtttaaacccggttaccggtaaaccccggtaaacggggttaacccctaaccgggtaagttaaccggggtaaaccgtttaaaccgtttaaaacccgggg

SEQ ID NO: 171462 - DNA, 845 bp, Homo sapiens
  misc_feature: GYAE6OF01BFNUW.27.78.H01.1.454.CMB.1.raw
  modified_base (121)..(121): a, c, t, g, unknown or other
  misc_feature (121)..(121): n is a, c, g, or t
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggggcatgagcaaaactgacaagtcaaggcaggaagatgttgccatcacaactcagttgggtttcngctgctcgtgggtccagcctcgaggggtnaattgtagctgactcagtctaccagtactttcagtctgtcgactacgaaaggagaaacgtcacctataccaccgtcggacccgggtacctaaggtccaaggacggttccggttagggtaactacggtaccttaacgacgtacggtaacccagacgaagtaacgacctacgggtacaacgtacctaaccgaaacgtccctacctactaactacgtaaggtactaccgtcccttaccctacgtccctaccgtaccgggtaaccggggttccccctagggtacggttacgtacggttacggacgtaagggtaccggtacttcggtaacgggtaaccctaatttaccctttacccaaccccctacggtaaacctaaccttaaccgaaagttacccggggactaacgggggtaaactccggttaaaggaaagttaccggtaacggtaccttaaacggtaaaccctttaaacctttaagttaaccccgtattacccgtaactaacgtaaacgttaccgtttaaacctttaacccgtttaactaacggacgttaccgtaaccgttaaccctcccgggtaaccggaaccggtaaaccgggactaaaccggtaaccgaacggtaaacgtaaacggttaaacgttacggtacgttaccgggactacccgtacttaaacccgtcgtttacccggttcgtttaaccc

SEQ ID NO: 171463 - DNA, 591 bp, Homo sapiens
  misc_feature: GYAE6OF01AHJM9.27.78.H01.1.454.CMB.1.raw
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaacgccaggtcagtcctaccaaagcctcctcatcaagtatgccttcccagtcccttctcgacgggtcccctcgaggttcagtggcagtggactcgtggacactatttccaccctcaccatcaatcgacgtggaagctagaagatcgtactgacttaacttactttacgtgtactactacgaacgtaacgttaccttaacctttacctacgtaagttacgtaacttcctacccgtttaccggaccgaaacgggtaccacggtacgtaggaacgttaacgtaaacgtacgttggtacgtaccgtacgacctacctagtcttcgttcttacccg

SEQ ID NO: 171464 - DNA, 864 bp, Homo sapiens
  misc_feature: GYAE6OF01C73IC.27.78.H01.1.454.CMB.1.raw
  modified_base (170)..(170): a, c, t, g, unknown or other
  misc_feature (170)..(170): n is a, c, g, or t
  modified_base (250)..(250): a, c, t, g, unknown or other
  misc_feature (250)..(250): n is a, c, g, or t
tcagagcgtcgtctcacgaccggtgctcgatttagtgtgagtagtttgggtttggggatacttaaaagaggttctttctctgggatgtggcatgagacaaaactgacaagtcaaggcaggaagatgttgccatcacaactctatttgggttctgctgctcgtcggttccngccgtacgagggtataattgtgtctgactcacgtcctaccagtactttcgacgttcgtagtacgacctaccgaaaagganaacgtaccacctactaccgccgtcggaccggaccagtaccgagtacggtcggttaggtagtacgtacttaaccgcgtacggtaaccaggacgaacggaacgaccgtaagggtccaacgttacccaaaccgaaccgtcctactacgtaactaactagtacgtccgtaccttccgttaccgttccttaccggtaccggtacccgggttacccttacgggtacgttaccgtaggggtacgtacgtaggtacggtactcggtaacggaccttaacttccgttaccccaacctctaaacccgttaacgttaaccaaacggttaccgaacccgggtaggtaaccgtacgtaacggtaaaccggctttaacgccggtttaacgtaaaccgtttaaactttttaccggttaaccgttccgtaaacgttacttaaaccggtaaccggtttaaacccttttaccccgtttaaaccgttaaccccgtaacgttaacggttacccgtaacccgttttacccccggttaaaaccggttaccccggggtaaaacgttaaaccccgggggtaattaaccccggggtaagttttaaaaccggggaaaccgtttaaaagggttaaacccgg

SEQ ID NO: 171465 - DNA, 766 bp, Homo sapiens
  misc_feature: GYAE6OF01D77N9.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttggggatgagcaaaactgacaagtcaaggcaggaagatgttgccatcacaactcatttgggtttctgctgctctgggttccagcctccgagggggtnaaattgtgctgactcagtcctccagtactttcagtctgtcgactacaaaggagaaactcaccactccaccgtcggccggccacgtacgaggacgtcggttaggtagtacgtaccttaacgactacggtaaccagacgaacgaacgccgtacggtcacgttacctaccaaacgtccttaccttacctaacttaccgtaaagtttacgttcggtaccctttaccccgtacggtttccccgtttccgtacccgggtacccgggggtttccccctacggggttacggtttcgacgggttcggtaccgtaggttcggtaacgtcggtacggacctaactactttccccgaacctacccaacctactaaccaaagtaccggtaccggtacggaagtaccgtaggaaactagttacgtaccgtacgtaaaccttaaccgttttaattcgttagtacctacgtacgtaacggttaacgtttaacctttaacctttaccacgttaacggtactaccgtttaccgaccgttaccggaacgtaacgggtacctacggtagtaacggtaccgtaaaactaacggtacgtcgaccggtctacgtacccagttactccgttcgtcttaccc

SEQ ID NO: 171466 - DNA, 787 bp, Homo sapiens
  misc_feature: GYAE6OF01CFHJX.27.78.H01.1.454.CMB.1.raw
  modified_base (358)..(358): a, c, t, g, unknown or other
  misc_feature (358)..(358): n is a, c, g, or t
tcagagcgtcgtctcacgaccggtgctcgatttagtgtgagtagtttggggtttggggatgagacaaaactgacaagtcgaagggcaggaagatgttgccatcaacaactcatttgggtttctgctgctcgtggttccagccgtcgagggtataagttgtgctgactcacgtcctactagtacctttgagtctcgtacgacctaacggaaaggaacgtaacgtccaacctataccgaccgtcggcccggacgtagtacaggtacggtcggttaggtaagtacgtcgttaacgacgtacggtaccgagacaacggaacgacgtacggtacgtacttaccgtaccgaacgtcttaccccngtaactacgtagtacgttccgtacccttccgtccgttaccttcggtacccggtccgggtacccgtcggtacggttcgaaggtcggtagtacggtacgtacgtcggtacgtaacgttaccttaccgttacccacccgtactaaccgtactaaccgtaacgtcgtaaccggtaggtacggaacgttaggtaagcggtacgtacgtacgttactttaaacgttcttaacggtacgtactacgtaacggttaacgaccgttttaacccgtttaaacttacctaagtaccggttacgttaccttaaccgttacgttaccggacgtaacccgaacgtacggttaaaccgaggtaaaccgttaaggtaaacccggttaggacggttccgaaccgttacaaccggttagttaacttcctttaagttcccgttacccg

SEQ ID NO: 171467 - DNA, 741 bp, Homo sapiens
  misc_feature: GYAE6OF01AL69G.27.78.H01.1.454.CMB.1.raw
  modified_base (145)..(145): a, c, t, g, unknown or other
  misc_feature (145)..(145): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggtccagcctccaggggtnaaattgtgctgactcagtctccagtactttcagtctgtgactccgaaagganaaagtcaccatcacctgccgggccagtcagagcgttggtagtagcttacacgtggtaccagcagaacgccaggtcagtctaccaaagcctcctacactactaagtactgtccttcccacgttccttccgtccggtaccgggttccccctacggtacggttcgagttcggtccgtaggtcgggtacttccgtcggggtaaccaccgttaaccttttcccaccccgttcaacccgtactacgaacttacggaccgttaggaacgacgttagaagtacgtacgtcgttacggaccttaaacgtttaacgttaacgttacggtacctataccgtaacgtaacgtttaacccttttaactttaacccgttacgtaaccgttcggtaacttacccgttaccccgttacgggttaacccgaaaccggggttaccgtaacccgtaaacggttacgggtaaaggtttaaaccgttaaaaccgggtaacggttaaacggtcgggtaaccttacggaaccctacccgttacttaccgttgttaccctttacccgg

SEQ ID NO: 171468 - DNA, 780 bp, Homo sapiens
  misc_feature: GYAE6OF01EY5OS.27.78.H01.1.454.CMB.1.raw
  modified_base (185)..(185): a, c, t, g, unknown or other
  misc_feature (185)..(185): n is a, c, g, or t
tcagagcgtcgtctcacgaccggtgctcgatttagtgtgagtagtttgggtttggggatcttaaaagaggtttctttctctgggatgtggcatgagcaaaactgacaagtcaaggcaggaagatgttgccatcacaactctattgggtttctgctgctcttcgggttccagcctccgaggggtanaaattgtgctgactcagtctccagtactttcagtctgtgactaccgaaaaggagaaacgtccaacctactccaccgtcggcccgggaccacgtacgaggtacggtcggttaggtaacgtacgtacttaacacgttacggtaaccacggactaaggaacgccgtaacgggtccgtaacgtacctaacccgaaacgtccttaccctactaacttaacaaagttctaccgtacccttaccctacgtttaccccgtttcgtaccgggtacccggggttccccgttacgggttacggttaccgtagggttcggacgtagggttcggacttcgggtacggtaactacgttaccttttaccaccccgttaccaaccctaacgttactaacgtaaccgtaccgtaacggtaacgtacgtacggtaaacgtcttacgggacttacgtaacctttaaaccgtttaacgttactttacgtacgttaactacgtaacgttaaccgttaacctttaccgtttaacctacgttaacgtactaccgttacgttacccgttaccggaacgtaacgggtaccacgtaacgtaggtaagtaacgttaaaacgg

SEQ ID NO: 171469 - DNA, 747 bp, Homo sapiens
  misc_feature: GYAE6OF01EUCPI.27.78.H01.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttcagcctccaggggtnaattgngctgactcagtctccagctttcagtctgtgactaccaaagganaaacgtcaccatccaccgtcgccgggccagtcagagcgtttggataggctttacgacttcggtaccagcagtaacgccgaggtcacgtctaccaacgctcctcatacaagttactcgccttcccacgttccttcgtcgtacgggtcccctaggtacgttacgtacgtcggtactggtggactcgtagggtaccaacgtctttaccacccctacgaaccctaataccaaagttaccgaccgttacgggaaactaccgttaaggtaaacgtacgtagtacgtaggtaaaccttaaccgttttaattaccgttacgttacctaacgttaacgtaacgttaaacgtttaaccctttaacccgttttaacccgaccgtttaaagggttaacgtaccgtttaacccggtaaccccgtttaaccggggtaaccccgtaaaggggtaacccgaaaccggttaaccggtaacgggtaacgttaaacgtttaaaacccggtagttacccgggtttacggacccgttcgaaccctaacccgttatttccggtcgtttaaccg

SEQ ID NO: 171470 - DNA, 753 bp, Homo sapiens
  misc_feature: GYAE6OF01DMY6C.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaattgtgctgactcagtctccagtactttcagtctgtgactaccaaaggaagaaagtccaccactcacctggcccgggccagtcgagacgtcggttggtagtacgtccttacacgtacggtaccagacaagaacgcctaggtcagttcctaccaaagccttcctactaataccaagttacttacgtcctttccctacggttccctttccgtccggtaaccggggttcccctcggtacggttcgtaggtcggcgtaggcggtactcggtacggacacgttactttacccaccctcaaccctatacctaaacgtacgcccggtaaggaacgtacgtaggaaacgttagtcggtaactacggtaacctttaacttttaatttacccgtacgtacctacttaaccgaagtttaaacgttaccctttaaacctttaccggtaaccgtaagggttaccgtaacctaccgtttacccggttacccggggaactaaaccggggactaccggtaaccggtaagggttaaaacgtaaacgttttaacccgggaaacgtttcgggtaaccgttacggtaccgtaccctaaccttacgttcctttacggtttacccc

SEQ ID NO: 171471 - DNA, 650 bp, Homo sapiens
  misc_feature: GYAE6OF01AR9SK.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccgaaaggagaaagtcaccatcaccgtgccgggccagtcagagtcggttggtagtagcttacacgtcggtaccagacagaagccgaggtcagtctaccaaagcctacctctatacgtaagttactcgtaccttacccgtacgttccttccgtccgtacggggttccccctacggtacggttcgaggtcggtacgtaggtcggtaacgtcggtacggtactacgttactttaccaccccgtaccaaccctacttacaacgtacgaccgtacggtacgacgtagtaacgtagtacgtactacgtacttaacttacttacgttacgtactatacgtacgtacgttacttacttactactacgtacgtactctacgtaccgtacgaacggacgtacgacgtagtacgtacgtaacgtcgtaaaaaacgtcgtacgtcgtacctactactcgttcgttcgttacccg

SEQ ID NO: 171472 - DNA, 839 bp, Homo sapiens
  misc_feature: GYAE6OF01BJ8O8.27.78.H01.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagaaattgtgctgactcagtctccagtctttcagtctgnactacgaaaggacgaagtcacnctaccaccgtgccggaccagtccagtacggtcggttaggtacgtacgtcttaacgacgtagtaccagacgaacggaacgccgtaaggtacctacggtacctaaccgaaacgtcctacctacgtaagtactaaacggtttactccggttacccctttaccccgtcgtttaccccgttacggtacccggtaccccgggttccccgtaacggggttacggttaccggacggttcggtaaccggttacggtacgggttacgttcccgggttaacgggaaccttaaccgtttaacctttaccccgtaaccccggttaacccaacccttaaagttaaccccggttaaaacgttaccgggaaccggttaacgggtaacgtaacggttaacgggtaaaccggtacgttaaccgtaccgttaaccggtaaacctttaaaccgtttacgtttaaccggttaacttaccgtaacttaccgtaacggtttaaccgttaacctttaaccgtttaacctaaccgtacggtacgttacgttaccgttacggtaccggtaccgaacggtaccgtacggtaacgtacgaagtaaccgttaagacgtacgtcgtacgaccgtacacttaactcgttactcgttaacccg

SEQ ID NO: 171473 - DNA, 808 bp, Homo sapiens
  misc_feature: GYAE6OF01A1CA4.27.78.H01.1.454.CMB.1.raw
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctcgagggtnaaattgngctgactcgacgtctaccagtctttcagtcctgtacgtactaccgaaagganaacgtccaacctatccaccgtggccggaccagtacagacgtcgttaggtagtagtacttacacgtgaccgagacagacgacgacggtacacgtacgactaaacgccttcgtacattacgacgtagtcgccttaccgtaccgttccttaccgtcggtaaccggttcccctagggtaacgtttccgaacggtggacgtaggtacggacgttggtacggtactacttacgttaccctaccgtacctacgtaacctactacgttacgaccgtcggtaacaccggttagtaacgtacgttcgacccgtttacgtaacgttaaccttttacgttaccgttacgttaaccggttaacgtacccggttaacgttaaccgttttaaacccgtttaaacccgtttaaaccccggtaacggttaaaccggtttaaccggttaccccgttttaaaccccgggtttaaccccgtttaaccccgggggtaaaccggttaaaaccccggggtcccggttaaacccgggttaaacccggttaaaacgggttaaacccggggttaaaaccgttttaaaaccccggggg

SEQ ID NO: 171474 - DNA, 718 bp, Homo sapiens
  misc_feature: GYAE6OF01B780C.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctcgtgggttccagcctccgaggggtgaaacttgtgctgactcagtctcccagtacctttcagttctgtanacctaccgaaaggagaacgtcaccatccacgtcggcccggccagtcgagtaggtccgttaggtacgtagtcctttaacacgtacggtaccagacacgaacgccgaggtcacgtactaccgaacgtcctcctacactactaaagttcgtcgtacccttccgtaccgtttaccgttccgtaccggtaccggggtcccctacggtacggttcggtacggtggaccggtaggtacggtacgtacgtacgggtacctacgttaccttacccgaccctacctaacctaactacctaagtcgtaccgtacggtaaacgtctaagaacgtactcgtactacgtacttaacttacgttactacgtactacgtacgtaacgttacgttaacttacctttaccacgtaagtctacgttacctaccgttacggaacggtaacggtaacgtaccgtaacgtaaggtaaccgttaaacgttaaacggtcggttacggtcggtacgaccgtacctacgttaaccttcttaccggttcc

SEQ ID NO: 171475 - DNA, 659 bp, Homo sapiens
  misc_feature: GYAE6OF01BJRAC.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcatttgggtttctgctgctctgggttccagcctccgaggggtgaaattgtgctgactcagtctccagtactttcagtctgtgactaccgaaaggagaaacgtcaccatccaccgtcggccgggccagtcagagcgttggtagtagcttacactggtaccagcagaacgccaggtcacgtctaccaaagctacctcatcaagtatcgccttccacgttaccttcctccggtacggggtccccctggtacggttcgtaggtggctaggtggactcgtcgggacacgtacttccacccctcaaccctataccaatacggtacctaagggaacgtcgtaagaacgtagtcgtaccgtggtaacctaactttaacgtttaccttagttacctagttacgaacgttaacgttaaccctttaaccttttacccgtacgtaaacggttcgtaacttaccgtaccccgttacgggacccgaaacggggtactacggaacgtagggtaaacgtaaacgtttaaaaccggg

SEQ ID NO: 171476 - DNA, 884 bp, Homo sapiens
  misc_feature: GYAE6OF01D79PP.27.78.H01.1.454.CMB.1.raw
  modified_base (695)..(695): a, c, t, g, unknown or other
  misc_feature (695)..(695): n is a, c, g, or t
  modified_base (704)..(704): a, c, t, g, unknown or other
  misc_feature (704)..(704): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgtctgtctcggttcggtcacgtccgtacggtaggggtaataattggtcgtcgtacgtacctacgtacgttaccctaccgtacgtttacctttacgtacgttcgttacgtaccgtaacccgtaaaacggaaaagggtaaacgtaaccgtacctaacctacctaccgtacccgggtccgggaccccgggaccgtaacggtacggtaacggtacggttacgggttaaggttacgtaacgttaccttaacgtacggtaccggtacgacgacggaacgtaccgacggtacgtacgtccttaccaacgtaaccgtccttaccgtaactaacgttacgtaacgttccgtaccgttccccgttaccgtccgtttaccttcccgggtaccgggttaccccgggtttcccgtaagggttaccgttaacgggtcgtacggtacggttacggtaggttaccgtacgggtacgttaaccttacgtttaccctaccccgtaaccctacgtaaccctaacgtaaacgtaacgtcccgggtaagtaacggtactacgtaaggactcgtacggtacgtaacgttacttaaccttntttacgtanacgtacgtacggtacttaaccgttacttactcgtaactagtccttaccgtacccggttaggaacccggtacggacgtaacgacggttaacgggaagttaaaccgtaaacggttccggtaaggttcccgggacttaacacccgtactttaccgttatacccggttttcctaccgttccccg

SEQ ID NO: 171477 - DNA, 807 bp, Homo sapiens
  misc_feature: GYAE6OF01DYMCF.27.78.H01.1.454.CMB.1.raw
  modified_base (338)..(338): a, c, t, g, unknown or other
  misc_feature (338)..(338): n is a, c, g, or t
tcagagcgtcgtctcacgaccggtgctcgatttagtgtgagtagtttgggttggggggcatgagcaaaactgacaagtcaaggcaggaagatgttgccatcacaactcagtttgggtttctgctcgctcgtgggttccacgccctccggaggggtataagttgtgctagactcacgtcctactagttaccttcgtagtcttgtacgacctaaccgaaaaggaacgtaaacgtaccaaccctactacccaccggtccgggacccgggacctacggtacgacggtaggttcggtttaggtacgtacgtacttacgtaccgtacggtacacgacgagaacnccgtacgtctactaccacgtactcctaccgtatactaccgtaagttctccgttcccttccgtaccgtttcccttccggtaccgggttaccccgggttcccgttacggttacggtcgtaggtcggaacgttggtacgtacgtacggtacggtaacctacgtttaccctaccgtacctaccaaccgttataaccgtacgtaaccgtaccggtaggacgtacgaaggtacgtacgttccggtagttaccttaaaccgtttaatttaccttacgtccgttaacctaagttacggttaacttacctttaaccctttaaccgttacgtaacgtattaccggttaaccttaccgttaaccgggtaccgggtaaccgtaaccgggacctaacgggttaaccgtaaggtaaacgttaacgtaacggtcggtacggtaccgtactaaccgtaccctaagtttctaaccgtttctacccg

SEQ ID NO: 171478 - DNA, 701 bp, Homo sapiens
  misc_feature: GYAE6OF01AI4IQ.27.78.H01.1.454.CMB.1.raw
  modified_base (182)..(182): a, c, t, g, unknown or other
  misc_feature (182)..(182): n is a, c, g, or t
  modified_base (363)..(363): a, c, t, g, unknown or other
  misc_feature (363)..(363): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcaacaactcattgggtttctgctgctctgggttccagcctccgaggggtnaaattgtgctgactcagtctccagtactttcagtctgtagacctaccaaaagggagaaacgtccacctactccaccgtcggccggaccagtccaagacgtcggttaggtacgtacgtccttaacacgtaggtaccagacaagacgccgagtcactacacaaacgctcctacatcgtaagtntcgtaccttccgacgttcccttacgtccgaccgggttcccctggtacgttacgaggtcgacgaggtgacgtcgacggaactacgtacttaccgacctacaacctaacaactaacgtacgaccgtaacggtaacgtcgttaagaacgtctacgtaccgtagtaaccttaaaccttacgttactacggtactaacgtaccgtaaaggtaaacctttaccgttaaccttttaaacccgtaacgaaacgttcgtaaccgttaacccgttaacccgtaccggtaaacccgaaacgggtaacccgtacggaacgttaacggtaaacggtaaacgttaaaaccgg

SEQ ID NO: 171479 - DNA, 883 bp, Homo sapiens
  misc_feature: GYAE6OF01B2RKP.27.78.H01.1.454.CMB.1.raw
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcaacaactcattgggtttctgctgctctgggttccagcctccgaggggtgtaaattgtgctgactcngtctcctagtacttcagtctgtagacctaccgaaaaggaagtaaacgtccaacccacgtaccaccgtaccggccccgggaccacggtcgaaggtacggtcggttaggtaggtacgtacctttaacgtacgtacggtaccgacgacgaacggaacggcgtacggtactaccgtaccgtaccaaaccggtcctccgtactaactaacgtaagttacgtacgtcccttacccgtacggttacccttccgtacccgggtacccggggttccccgtacgggttacggttacgtacggtccgggtagtaggttcggtaacgttccggtacggggtaactaccttaaccgtttcccgtaaccccttaccgaaccccttaacgtaaccgtaaccggttaccgtaacgggttaacgggtaacgtaccggtaaacgaacgggtaacttacggtaaccgttaacgggtaacccttttaaacgtttaccgtttaacgtttaccgaaaccttaacccggttacgttaacccgggttaaaccttttaaacccgtttaaacccgtttaccgttaacctaaacggtttaccggttacccttaacccgggttaccccgtaacggtaaaccccggggtaacggttaaacccggtaacccggtaaaccggttagggaaaacccggttaaggtttaaaacccggg

SEQ ID NO: 171480 - DNA, 881 bp, Homo sapiens
  misc_feature: GYAE6OF01C6ZZ9.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtggtccagcctcgagggtgaattgtcgctgactcagtctaccagtactttcagtctgtacgtacctaccgaaaaggtagaaaacgtccaacctacttacccgacccgtacggccccggggacctacggtaccgaaggtacggttcggttagggttaacgtacgtaccgttaacgtaccgttaccgggaaccaacggcgaaacggaaccgaccggtacggttactaacggttaccctaaaccgaaacgtcccttacctctaacgttaaccgtaagtttacgtccgttacccttacccgtacgtttacccgtttccgtacccgggtacccgggttacccccgttacgggtaccggttacggtacggttacgggaccgttagggttcggtacgtttacccggacggttaacctaaccgtttaccttaccccgtaaccccttaccgaaaccgtaacgtacgtaaaacctaccgggttccgtaaacggtaacgtaccgtaaggtaaacgtcgttagtaccgttacggtaaccttaaacgtttacctttaacgtcctaagtcttaaccgtaacgtaaccttttaacccgtacgttttaacccgaacgttaacgttccgtaaccgttacccggttaccgttaccgggaaccgtaaacggtacccaacggtacggttaaagaaacgttaaacggttaaccgtaagggttccggtacgtccgaacctaccggttactaccgtttacgtccgtttaccttacccgg

SEQ ID NO: 171481 - DNA, 761 bp, Homo sapiens
  misc_feature: GYAE6OF01A1TEK.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggtttctgctgctctgggttccagcctccgagggtgaattgtgctgactcagtcctccagtactttcgagtctgtacgactaccaaaggagaacgtaccaccatccaccgtcggaccggaccagtccgagacggtcgttaggtaacgtagtccttacgacgtcggtaaccagtacgaagaacgtccgaagggttccaacggtacctaaccaaacggtccttacccgtataactaccgtaaagtcgttacgtcccttacccgtacgttacctttccgtaccgggtacccggggttcccctacggtaacgggtttccagggttacggaccgtaaggggttcggacgttcggacgggtaaccgtacctttacccgtttacccgaccccttaaccgaaccttaacgtaaccgtaaacgtaccggtacccgttaagggtaaacgtaccggtaagaaacgttcgacggtaaccttacgggtaacttaacttttacgtacgtcgttactaccgttagtaacgtaccttaacgttaaccctttacgtaagacgttaacgtcctaacgtacccggtacgtaccgaaacgggtacacggttaacgtaggaaacttacgttaaacggg

SEQ ID NO: 171482 - DNA, 762 bp, Homo sapiens
  misc_feature: GYAE6OF01C0OCP.27.78.H01.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagagcgtcgtctcacgaccggtgctcgatttagtgtgagtagtttgggtttgggggcatgagcaaaactgacaagtcaaggcaggaagatgttgccatcacaactcatttggtttctgctgctctgggttccagcctccaggggtgtaaattgtgctgactcagtctccagtactttcagtctgtnactaccaaagganaagtcaccntccaccgtcgcccggacagtacacgngtcgttagggtacgtacgtacttaccgacgttagtaaccgagactaaggaacgccgaggtacacgttccaccgaaacgcctaccctactactacctaagtctcgtccctacccctgttccctttcgtaccgttccgggtcccctaggtaccgtgtaaggttcggactagggtgacttacggtaccggtactaacgtccttacccgacccttacgaccctagtacctaacgtccgtacgttaacggaacgtcgttaacgaacggtacgttacgacgttaccgtaacctttatttaaccgtttccgtaacgtaccgttaacgttaccgtaaacgtttaccgttaaccttttaaccctttaaccgttaacgtaacggtttacgaacctttacccgttaaccgttccgggaaacccggtaacgggttaacccgaccggttaaggtacgtaaaacggttaacccgtaaaaggttaccggtaaccgtacgggtaccttaacggacccctagttaaccctgttcgtttacccg

SEQ ID NO: 171483 - DNA, 720 bp, Homo sapiens
  misc_feature: GYAE6OF01BK4ZX.27.78.H01.1.454.CMB.1.raw
  modified_base (182)..(182): a, c, t, g, unknown or other
  misc_feature (182)..(182): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggttctgctgctcgtgggttccagccttccgaggggtntaaattgtgctgactcacgtcctccagtacctttcagtcttgtacgaactaccgaaaaggacgaaacgtccaacctataccacccgtcggccccgggaccaggtcaggacgtcggttaggtaaggtacgtccttaccgacgttcggtaaccagccgagaacgccgaggtcacgtaccaccgtaactccctacctctaactacgaagtntccgtcccttcctacgttcccttcgtacccggtaccgggttcccctgggtacggttccgagggttacggctaggttacggtacgttccggtagggtaaccctcgttacccgtttcccccaaccccgtacctaacccctaacgttacctaaacgttaccggaccgttaagacggtacgtagaacgtctcgtactacgtaacttaaccgtttcttaatccgtaacttatacgtacgttactaaccgttacctttacgtactaacggtcttactccggttaccgacccggacgaaccggtacgtacgaacggtagaaaccgttagtaacccgg

SEQ ID NO: 171484 - DNA, 782 bp, Homo sapiens
  misc_feature: GYAE6OF01AFGDB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgaggggtgaaattgtgctgactcagtctccagtactttcagttctgtcgactaccgaaaggagaaacgtccaccatccaccgtcggcccgggccagtaccagacggtcggttaggtagtacgtcttaaccgacgttacggtaccgagtacgaagtaacgccgacggtacacggttcctaacccgaaacgtcctacccctacaactacgtaaaggttactcgtccttaccctacgttcccttccgtaccggtacccggggttacccccgtacgggtacggttaccgtagggtacgggacgtaacggtggtacgttacggtacgggaacctaacgttacctttacccctaacccccttaccaacccgtaactacctaaacgtaccggtacccgtagggaactcggtaaggaaacggtctcggtaaccgttacgtaaccttaaaccgtttacttaacgttacgtacctaactacgtaaacggtttaccgtttaactttaacccgtttacctaacgtaacggtactaaccttcccgtacccggttaaccggacgaaaccggtacgacgtacggtaaggtaaacgttaacgtaacggtaacgtcggtaggtcccacgtacctaactaccgttccgtgtttccttacccg

SEQ ID NO: 171485 - DNA, 819 bp, Homo sapiens
  misc_feature: GYAE6OF01AVKE8.27.78.H01.1.454.CMB.1.raw
  modified_base (634)..(634): a, c, t, g, unknown or other
  misc_feature (634)..(634): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatccacaactcattgggtttctgctcgctcgtcgggttccacgtcctcggaggggtataaacgttgtcgcgtgtacctcgacgttcctaccgtagttaccttttcgagttcgttcgtacgtaaccgtaaccggaaaagggtaacgtaaacgttaccacctaacgttacccgaccgtcgggacccggtacctaaggtccgaaggtacggtcggttacggtagtacgtaccttacgtacgtacggtaccaggactaacggaacgtccgtaggtccacgttccaccgtaactcccttactactaattacgtaacgtactccgttacccttaccgtaccgtttccgtaccggtacccgggtacccggttcccgtacggttaccggttacgtacgggtacgtcgtacggtacggtacgttaccggttacggaaccttacttacccgttaccacccttacgaaccctactaccgtaagtaccgtacgtaagttaccgacgtaacgaggtntaccggtactaacgttactttaccgttaacgttacctagttacacgttaacggacttaaccgtttaaccttaccgttaaaccgttaggtacggtaaccttacccttacccggggtaacctaaccgggtaacccgtaacgggtacccaacggttaacgtacgggtaacccgttaaaacggtaccgg

SEQ ID NO: 171486 - DNA, 783 bp, Homo sapiens
  misc_feature: GYAE6OF01AH74Z.27.78.H01.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (743)..(743): a, c, t, g, unknown or other
  misc_feature (743)..(743): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtcggttccagcctcgagggtgaaattgtncgtgactcgacgtcctaccagtactttcagtctgtgacctacaaaggtanaaacgtcaacctagtccaccgtcggacccgggcagtacaggagtcggttaggtagtacggtacctttaacacgttacggtaccgagtacgtaacggaacggccgtacggtaccgtacgtaaccgtaacccgtaacgtaccctaccttaaccacggttaacaacgttactcgtaccttcccgtactttcccgttaccgtaccggtaccgggtaccccttacggtacgttacgtacggtcgtacgtacggtagtacgtacgacggactaacttaccgttacccacccgtcaacgtaactacgtaacgcgtaccgtaaggaacccgtagtaacgaacgaactcggtacttacgtaacgttaaccgttaactacgtaccggtactaacgtacccgtaaacttacggttaacccctttaaccgttaccgttacgttaaccgaacgttacgttacccgtaacccggttacggtaaccccgtaagggaccctaacggtacggtaacggtaaacgttaacgggtaaactacggttaacggtaccggntaacccgtacgtactaacctcgttacgttccgttaacccg

SEQ ID NO: 171487 - DNA, 703 bp, Homo sapiens
  misc_feature: GYAE6OF01DGAV0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagtaaattgtgctgactcagtcctccagtactttcagtctgtgactaccgaaaggagaaagtcaaccatccaccgtggcccggccagtcagagtcggttaggtagtacgtcttaacacgttcggtaaccaggcaaggaacgcctaggtctaagtcctaccaaacgcctccctactaacttacgtaaagttctcgtcccttaccccgtaagttcccctttacgtccggtaacccggggttccccctagggtacggttaccacgggttcggaccgtaggtggtacgttacggtacgggtaacctaccgttaccttttaccccaacccccgttcaaaccctataacctaacgtacgcgtaacggaactacgtaagaacgtagtcgtacgtagtaacctaactttactacgtactacgtactactaacgtacttaccttaacctttaaccgtacgtaagttcgtacttccgaccgttaccggaccgtaacggactacggacgtagaacgtaaacttaacgacgttggacgtccgtacgcctactgttactcgttctaccg

SEQ ID NO: 171488 - DNA, 895 bp, Homo sapiens
  misc_feature: GYAE6OF01DYSP8.27.78.H01.1.454.CMB.1.raw
  modified_base (185)..(185): a, c, t, g, unknown or other
  misc_feature (185)..(185): n is a, c, g, or t
  modified_base (228)..(228): a, c, t, g, unknown or other
  misc_feature (228)..(228): n is a, c, g, or t
  modified_base (696)..(696): a, c, t, g, unknown or other
  misc_feature (696)..(696): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcatttgggtttctgcttgcttcgtgggttccacgcctcgaggggtntaattggtgctcgactctacgtctaccagttaccgttcacgtntgtagactaccgaaaggacgaacgtccacctactccgtacgtccggaccggctaaggtcacgggtacggtcgggtttacggtaacgttacggtaccttacgtacgtaccggttacccgaggaccggaaacggtaaccgaccggtacgggttacctacgttaacccgtaacccgtaaaccggtcccttaccttagtaaccgttaacgtaacgttacgtccgttacccttaccggttacctttcccgtttacccggtacccgggttaacccgggggttcccccgtttacgggttacgtttaccggacggttcccggtaacggttaccggttacggggttaccgtaccggggtttaaccgggaacccttaacctttaccgtttacccccgtaccctttacccgtaaacgtaaccgttacgtaaacgtaccggtaccggtagggtaaaccgttaacgtaggtaaaacggttntaccgttacggtacgttacctttaaacggtttacgttacgtacgtttacgaacttacttaccggtttaaccgttaacgtttaccccttaccgaaagttacggttacctaaccggttttaccccggtaccgttacccggggaacgtaaccggtaaccgttaaggtaacccgggaagttaaacgttaaccggttaaaccgg

SEQ ID NO: 171489 - DNA, 762 bp, Homo sapiens
  misc_feature: GYAE6OF01CLA0Q.27.78.H01.1.454.CMB.1.raw
  modified_base (145)..(145): a, c, t, g, unknown or other
  misc_feature (145)..(145): n is a, c, g, or t
  modified_base (739)..(739): a, c, t, g, unknown or other
  misc_feature (739)..(739): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcgagggtnaaattgtgctgactcagtctctagtactttcagtctgtgacctacgaaaaggagaaaacgtcaccgatccaccgtcggcccgggccagtccaggacgtcggtttaggtaagtacgtcttaacgcgttacggtaaccaggacaaggaacgccgaggtctacgtacctaccaacgcctacctcgactacgaatagtcgccttccacgtcctttcgtaccgtaccgggtcccctacggtacgtcgaggtgacgtaggtgacgtcgtacggactactacctttccaacccgtacacctatacctaacgtacgtaccgtaggtaacgtacgtaaggtaacgtacgtacgtacgttacgtaacctttaaacgtttacctttaagttaccgttactaacgttaacgtaacggtttaaccgttttaaccctttaaccgttttaacccgtaacgttaacggtacttaaccgttaccccgttaacccgttaaccggggaacccgtaacgggtaaacccgtaccggtaaacggttaacgggtaaacgttaaaccggttaaacggaacccggtttgggacccggtccgttaacgaccttaaccgtnttaccgttacgttcccttacccg

SEQ ID NO: 171490 - DNA, 756 bp, Homo sapiens
  misc_feature: GYAE6OF01CMVRN.27.78.H01.1.454.CMB.1.raw
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcagttgggtttctgctgctcgtgggttccacgtccgtccgaggggtagtaaacgttgtgtcgtgtactacgtacgttcctaccacgttactttcgagttcgtgtcgacctaaccgaaagggaacgaacgtaccaccactccgaccgtcggccggaccacgtcaggagtcggttaggtagtacgtacttacgcgtacggtaccgagacgaacgacgaccggtaggtccacgtcctaaccgacgtcctacctanactataacgtntccgtccttcctacgttccttacgtaccgggtacccggtccgtcggttacggtcgtacggtcggagtcggtagtcgtacgcggtaacctaacgttccttacccgacccctcaactacgtaactaacgtcgtacggtacggaacttgaacggaatacgttcgtaagtaccgttaacttttaaaccgtttgtaccgttataccttagtaacccgttaaggtttacccttaaacccttttaccggtaaaccttagtaaacgttcccgttaaccgttaaccctacccgggttaaccgaacggttaaacccgtacgtaacggttaacgggtacggttaaaccggttaaccttaaacggg

SEQ ID NO: 171491 - DNA, 640 bp, Homo sapiens
  misc_feature: GYAE6OF01EGWOV.27.78.H01.1.454.CMB.1.raw
  modified_base (200)..(200): a, c, t, g, unknown or other
  misc_feature (200)..(200): n is a, c, g, or t
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaagganaaagtcaccatcacctgccgggcagtcagagtcgtttaggtagtagcttaacacgtcggtaccagcagaacgccgaggtcacgtcctaccaaagcctacctcgtaactaccgaagttactcgtacccttccctacgttcctttcgtccgtaccggggtcccctacgggtacgtttcgaggttcgacgtaggtagacgtcgtacgggactacgtactttcccaaccctccacactacaatcgaccgtagaacgctagagtangtctgacttaacttagttactgtctatacgtagttaaccgttacttacttaccactagtgtaacttccgaacccgttcggaaccgaacgggaaccacggtaacgtagggaaacttaaaccggttaaagaccgttgggacgtctacggtacctaaccgtctttccttgttaccttacccg

SEQ ID NO: 171492 - DNA, 981 bp, Homo sapiens
  misc_feature: GYAE6OF01CGQY6.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcaacaactctagtttgggtttctgctgctcgtggttccacgcctcggagggtagtaaagttgtgctagacctcgtacgttcctaccgtaagttacctttcgacgtccgtagtacgaaccgtaaccgaaagggtaacgtaaacgtccaccactccgacccggtccgggacccgggacctaggtaccgaggtacggttacggtttaggtaacgttacgtaccttaacgtacggtacggtaaccagaacgaacggaaccggaccgtaacggtacctaaccgttacctaaccgaaaccgtccttacccgtactaagttaacgtaacgtttaccgttccgttaccccgtttacccttaaccggttttccccgtttacccggtacccgggttaccccggggtttacccccgttcgggttaccggttacggttaacgggcggttacggtacggttacggtacgttcggtaacggtaccttaaccgttaccttacccacccgtacctaactaacgtacctaagtaccgtacggtaaggacgtagtaagtaacgtacgttacgtacgttaccgttaaacctttaaaccgttttacgtaaccgttacgttaacccgttaacgtaaccgtttaacgttttaaacccggtttaacccctttttaaacccgtttacccgtttaaaggtaacccggtttaaccgtaaccccggttttaacccgttaacccccgggttaacgggtaaccccgggtaaaacgggtaccggttaaaccggtaaacgggttaaaccggttaaacggttaaaaccgttaaacgggttaccggtacgggttaccgttaaccggttacctaacccgtttaccgttacctttccgtttccgtttaacgttaccccg

SEQ ID NO: 171493 - DNA, 688 bp, Homo sapiens
  misc_feature: GYAE6OF01BEJI7.27.78.H01.1.454.CMB.1.raw
  modified_base (319)..(319): a, c, t, g, unknown or other
  misc_feature (319)..(319): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggggtgaaattgtgctgactcagtctccagactttcagtctgtgactccaaaaggagaaagtcaccatcacctgccgggccagtcagagcgttggtagtagcttacactggtaccagcagaacgccaggtcagtctaccaagctcctcatcaagtatcgcttcccagtcccttcncgacggggtcccctggaggttcagtggctaggtgactcgtgggacacctattttaccaccccctcaacctattaccaaacgttacgcccgtagggtaaacgccttaggaaagtacgtagccgtagtacctaaacctttatttaaccgtgttacctaactctaagtaacgggtttaaaccctttaccttttaaaccccttcgtaaacgtttacgggtaccttaacccgaacccgttttacccggggaccccgaaaaccgggggtaaccaaccgggttaaccgtagggtaaacccgtaagttaaaaaccgggtacccttaggggttcggtacccggtcgtacccgtacccttaattcccgttggttacccc

SEQ ID NO: 171494 - DNA, 695 bp, Homo sapiens
  misc_feature: GYAE6OF01E2KQ7.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtcgactaccgaaagggaagaaacgtccaccactaccaccgtcggcccgggacctaggtacaggacggtcggttaggtacgtacgtacttacacgtcggtaaccagacagaacgccgacggtacacgtacctaccgaaacgtcctacctactatactaacgttacgtacgtacccttccctacgtttcccttccgtaccggtaccggggtcccgtacggtcggttacgtaggtcgggacgtaggtcggtacgttcggtacgggaacctacctaccgtttacccaccccgtaccaacctaactacgtaacgtacgaccgtaggaacgtacgagtagagttccgcgttaacgtaccgtttaacttacttacgttagtactagttacgtacggtacctttaaccttaccttaccacgtacgtactacctaccgtccggtaccgacggaacggtacacggtagtacgtaagtaacgtaaacgg

SEQ ID NO: 171495 - DNA, 740 bp, Homo sapiens
  misc_feature: GYAE6OF01DKYD7.27.78.H01.1.454.CMB.1.raw
  modified_base (193)..(193): a, c, t, g, unknown or other
  misc_feature (193)..(193): n is a, c, g, or t
  modified_base (249)..(249): a, c, t, g, unknown or other
  misc_feature (249)..(249): n is a, c, g, or t
  modified_base (401)..(401): a, c, t, g, unknown or other
  misc_feature (401)..(401): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctcgtcgggttccacgccctccgaggggtagtaaattcgtgctgactcagtcctccagtacttcagtctgngacctaccgaaaggagtaaagtccaccatccaccgtcggccgggaccagtcaaggngtcggttaggtagtacgtcttaaccgacgtcggtaaccagacgaacgacgaccgtaggtcacgtacctacgaactcctacctcatacgtaagtctccgtccttccctacgttccttccgccggtacccgggttcccctaggtacgttaccgnggtcggacgtaggtaggacttacggcggtaacctactacttacccaccctcaacactacaacgtcgtaccgtaggaactcgtaagaagtctcgactacgtaacttaactttacgtacgttactaccgtataacgttacgttaaaccgtttacctttaaccgttaaccgtacgttaacggtacgtaccgttaacccgtacccgtttaaccgggaaccggttaaccggaaccccgtacggtaaacggttaaagggaaaccttaaaaaccgggttaacgtaccggttagggtaccgtaccggtacctaaccgtaaccttgtttaccgtcttttcccgtaacc

SEQ ID NO: 171496 - DNA, 782 bp, Homo sapiens
  misc_feature: GYAE6OF01A0QYB.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggttggggatgagcaaaactgacaagtcaaggcaggaagatgtgccatcacaactcagttgggtttctgctgctcgtggttccacgcctacgaggggtanaaattgcgctgactcgtaacgtctacctagtactttcaggttccagtacgaacgtaccgaaaggaacgtaactccaactactaccgtaccgtcggacccggactacgtcgaaggtagttccggttaggtagtacgtactaacgcgttacggaaccagactaagaacggtcctaaggtctaacgtaccaccaaagtccctacctagaacgtaaccgtaagtctccggtacccttaccggtaacgttcccgttaacgtaccgggtaccgggtacccttacgggttacgtacgacggtcgtacggtaggttgacgttaccgaaggtaacccttacttaacccttaccaaccgaacctaaccgtatacgagtaccggacgtaggaactaggtaacggaatacgtacggtacttaacgacgttaactttaagtaccgttagtaaccgattaacggtaagttaccttaaccgttttaacttacgaacggtaacgtactaccgtttaccgacgttacggaccgtaaaccgacggacgttaacgtaacggtaaaaccgttacgtaaaaggttcccgtagggtaacccgtagaacccgttaccaacggttttaacttccgggttaacccttccggttaaaccc

SEQ ID NO: 171497 - DNA, 796 bp, Homo sapiens
  misc_feature: GYAE6OF01BDHK5.27.78.H01.1.454.CMB.1.raw
  modified_base (125)..(125): a, c, t, g, unknown or other
  misc_feature (125)..(125): n is a, c, g, or t
  modified_base (146)..(146): a, c, t, g, unknown or other
  misc_feature (146)..(146): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctntggttccagcctcgagggtanaaattgtgctgactcagtctccagtactttcagtctgnactacaaagganaagtcacatcacgtgccggccagtcagagcggttagtagtagcttacgacgtaggacctagacacgaagccgagtcacgtctaccaagtcctctanactacgtaagttcgtccgtaccttacccgtagtttccccgtttaccgtaccggttaacccggggttcccgttacgggtagtttacccgacgggttacggtccgtaggttaggtaccgttaccggttaacggggaccttaacgttacttttaccccgaacccgttacaaaccctacgttaccaaccgttacgtaccgtagggaactacgtaaggtaacgttactcgtacgttacggtacctttaactttacgtaacttgtaacctgtaacttacggttaaccgtttacttaaacccgtttaccgtacgtaacgttaacggttctaacccgttaccggtaacggacccggttaaagggaacccccgttaacgaaacccgggttaagggtaaacccggtttaaaacgtttaaacccccggggttaaccgttagggtaccggaccgggttttaaacccacccggtttaaaccttcccggtttacggtttaacccgttttaaacccccg

SEQ ID NO: 171498 - DNA, 855 bp, Homo sapiens
  misc_feature: GYAE6OF01DKP99.27.78.H01.1.454.CMB.1.raw
  modified_base (120)..(120): a, c, t, g, unknown or other
  misc_feature (120)..(120): n is a, c, g, or t
tcagagcgtcgtctcacgaccggtgctcgatttagtgtgagtagtttgggtttgggggcatgagcaaaactgacaagtcaaggcaggaagatgttgccatcacaactcagttgggtttcngctgctcgtgggttaccagcctacgaggggtataaattgtgctagactcgagtctaccagttacttcagttctgtacgacctaccgaaaggagaaacgtcaacactaccacctcggaccggacagtacgagtaggtcggttaggtacgtacgtaacctttacgaccgttacggtaaccgaagacgaacggaacggaccgtacggttaccgacgtacctaaccgaaacgtccttaccgtactaacgtaactaaaggtttacgtaccgtaccccgtttacccgtaacgtttccccgtttaccgttaccggttaacccgggtttcccccttaacggttacggttacgtacggttaccggtacgtacgggttacggtacgtacggtaacggtaacctaccgtttaacctttacccgaaccccttactaaacctaagtaacctaacgtaccggtaccggtaacggtaaacgtaccgtaaggtaacgttaagttacggtaaccttaacgtaccgtttaaacgtttaactttacgtaacgttaactaactacgttaaacgtacgtttaaacctttacctttaaaccgtacgtaacggttactaaccttacccggtaacccggtaacggaaccgtaaacgggtcctaaaccggtagtaaacggtaaacgttaaacgttaaaccggtcgttacgggtccgtaacgtaccaacgtaacccgtttacgtacgtttccgttaacccg

SEQ ID NO: 171499 - DNA, 789 bp, Homo sapiens
  misc_feature: GYAE6OF01B4HC6.27.78.H01.1.454.CMB.1.raw
tcagagcgtcgtctcacgaccggtgctcgatttagtgtgagtagtttgggtttgggggcatgagacaaaactgacaagtcaaggcaggaagatgttgccatcacaactctagttgggtttctgctgctcgtgggttccagcctccgaggggtataaagttgtgcgtgtaactcgtacttcctaccgagttactttcgacgttctggtacgaaccgtaacgaaaaagggaacgtaaacgtccaaccacctccaaccggtcggcccgggacctagaccgaaggtaggtccgggtttagtacggtacgacctttaacgacgtacgtaaccgagaacgagaacgaccggtacggtacctaagtacccgtacaaacgccttaccacctaactagtaacgtctcccgttacctaccgtacggttcccttaccggcggtacccgggtcccgtacgggtacgtttcgaggtcgtacgtaggtacgtacggtcggtaacggtacctaaccgttacctttacccacccgtaacctaaccgtaacttaacctaagtaccggtaccgtaacgggtaacgtagttaggaaacgtgttacggaccttacggtaacttaaacgtttcgaccttacttaagacgtacgtaacggttaacctaacgttttacctaatacgttaagtacgtacccgtacgttacccggtacggaacccgtaagggaaacccgtagtacggaaacgtaaacttaagggttaaccgacttcgggaggtaccctggaacctacctacgttcgtccttacg

SEQ ID NO: 171500 - DNA, 717 bp, Homo sapiens
  misc_feature: GYAE6OF01C8JCW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccacgtcctccgaggggtagtaaatttgtgtcgttgactcagtcctacctagtactttcgagttctgtacgactacgaaaggagaaacgtcaaccatccaccgtcggcccggctagtcgaagtcgtcggtttggtagttacgcttacgacgtcgtacgagcaagacgcgtaagtctacgtccaacgaacgtcctctacgatacgtaagttactccgttcctaccgtcgttccctttcgtaccggtaccgggttccccgtacggttacggtacgtacggtcggtcgacggttagtacggttcgacgggtactaccgttacttccaaccctactacctaagtactaaagtaccgtccgtacgtaacgtcgtacgtaagcgtacgtacgtagttaactacgttacttacgtctacgtacttacgtaacgttaacttaccgtttaactttacctaacgttaggttaccttaccgtaacccgttaccggttaaccgaccggtaacgggacctaacggtacggtaacgtaaacggtaaacttaacggtaggttcgtacggacctccgtactacctgttcctcgttctacccg

SEQ ID NO: 171501 - DNA, 830 bp, Homo sapiens
  misc_feature: GYAE6OF01BLV5Y.27.78.H01.1.454.CMB.1.raw
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccagcctccgaggggtgaattgtgctgactcagtctccgagtactttcgagttctgtcgtactaccgaaaaggagaaacgtccaaccatccgacccgtcgggacccgggcctaggtaccgaaggtacggtccggtttagggtaagttacggtaccttaactaccgtacggtaccacggacaagaacggaccgaggtacctacgtccgtaaccaaacgtcctccctagtaactacgtaagttctccgtacctttcccgtaacgtttcccgttccgtaccgggtacccggggttaccccgtcggtacggtttccgacggttacggacggtacggttcggacggttccgtacgggtactaaccttacgttacccctacctacccgtaaccaattaacgaacgttaccgggtaaccgtaacgggtaacgtaacggtaacggtaagttaccgtaggtccccggtaagttaaccctttaatttacccgtttaactccggtaaactcgttaacgtacgtttaaccttaacgtttacccttaccgtaagtacgttactacccgttacgtacccggtaaccgtacggaaaccggtaccgtaacggtaaccggttaacggtaacttaaaacggttaacggaccgggttacgtacggaacccgttaccgtccgttaaaccttcgggtaccgtttcccggtttaccc

SEQ ID NO: 171502 - DNA, 1024 bp, Homo sapiens
  misc_feature: GYAE6OF01C8LRD.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcaacaactcatttggggtttctgctgctcgttcggggttccacgtccgtaccggaagggggtagtaaaagtttggtcgccgttagaacctcctaacggttcctacccgtaaggttaaccttttaccggtagttccgttaggtaccgtaaccgtaaaccggaaaaaagggaacgtaaaaacgttacccaacccgaatacccgaacccggtccggggaccccggggaacctacggtaccgaaggtacgggttaccggtttaggggtaaacgttaccgtaacctttaaccggtacggttaccgtaaaccgaaggtaccgaacggaacgacccggtaaggtacctaacggtaccgtaaccgaaacgtccctaccgtactaactaacgtaacggtactccgtacccgttaccctaccgttcccttaccggtacccgggtacccgggttacccccggtggttaacgggttccgaagggttacggaccggtaaaggtcgggtaacgtaccgggtaacggtaaccttaacttaccctttacccgaacccctaaccgtaaaccttaaacgtaacccgtaaaacggttaccggtaccggttaacggggaaacgtacggttaaacgggaacgttcgttacggtaaccgttacgtaaaccctttaaacggttttaaccttagttaccggttaaactacttaaaaccggtacgttttaaacgtaaccccgtttttaaactttacccgtaaacggttaaggttaacccgtaacccttaacccgttaaccgggttaacccggaaccgggttaaacccgggacgtaaacccgggttacggtaaacgggttaaaacgttaaaaccgtaaaccgggttaacggtagggttcggaacccggtccgtaaacgaccccttaagtttccgtctttacccggttaccc

SEQ ID NO: 171503 - DNA, 671 bp, Homo sapiens
  misc_feature: GYAE6OF01C8ECS.27.78.H01.1.454.CMB.1.raw
  modified_base (151)..(151): a, c, t, g, unknown or other
  misc_feature (151)..(151): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
  modified_base (509)..(509): a, c, t, g, unknown or other
  misc_feature (509)..(509): n is a, c, g, or t
  modified_base (538)..(538): a, c, t, g, unknown or other
  misc_feature (538)..(538): n is a, c, g, or t
  modified_base (665)..(665): a, c, t, g, unknown or other
  misc_feature (665)..(665): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctcgtgggttccagcctccaggggtnaaattgtgctgactcagtctcagtactttcagtctgtnacctacgaaagganaagtcaccatccacgtggccgggcagtcagtagtcggttaggtagtagacttacacgtcggtaaccagtacaaggaacgaccgacggtacacgtacctaaccgaaacgtcctacccganaactaacgtaacgtctacgtccttacccctacgtttcccttcgtaccggttacccgggttaccccgtgggtaacgggtttccggaacggttacgggacgtaggtcggtaacgttcggtacgggaacctacttaccgtttcccaccgtacaacctatactaacgtcgaccgtagacgcgtagaacgtntacgatacgtaccttaattctacgtctanacgttacaaggtaactttacgtttaccttaccggataagtcgtactacctacggtcgaccgaacggactaccggtagacggaattaactaacggtagtcggtacgactcgtaccacttacgtccgtnttaacc

SEQ ID NO: 171504 - DNA, 708 bp, Homo sapiens
  misc_feature: GYAE6OF01AINAD.27.78.H01.1.454.CMB.1.raw
  modified_base (181)..(181): a, c, t, g, unknown or other
  misc_feature (181)..(181): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggggcgatgagcaaaactgacaagtcaaggcaggaagatgttgccatcacaactcagttggtttctgctgctctgggttccagcctccaggggtgaaattgtgctgactcagtctccagtactttnacgtctgtgacctaccgaaaggagaagtcacctatccacctggcccggccagtcagngcggttgtanagcttacacgtgtaccagctagagcctaggtcatcctacgaacgtctacctcactacaagttancgtaccttcccgtactcctttactccggaccgggttcccctacggtagttccgaaggtcgggtaactggtacggnttacgtagggaccctagttctttacccgccctactacctatacgtaacaccgtcgaacgtacgtcgacgtaagtactcggacttacgtaaccttaacttacgttaccctagttactacgtaccgtaaaggtacctttaaccgtttactttaacccttacggtaaaccgtttcgtaaactacccggttaccgttacccgggaaccgtaaacgggtacgtacccggtaaagtttacgggaaacgttaaccgtaaacccgttaaccgttagggaccgggttaccctacgggaacctttaccctacgttccgttaacggtttccc

SEQ ID NO: 171505 - DNA, 835 bp, Homo sapiens
  misc_feature: GYAE6OF01CF4P1.27.78.H01.1.454.CMB.1.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggtttcngctgctctgggtccagcctcgagggtgaagttgngntgactnacgtcaccagtacttcagtctgtcgactacgaaagacgaagtccacatcacgtcggccggcagtcgagtacggtcggttaggtagtacgtacgtaccgtacgtacgtacgacgacgaacgacgaccgacggtacgtacgttacccgtaccgtaacgtcctacctactaacgtacgtaagtcgtaccgtccttaccgtacgtttaccgttcgtaccggtaccggtacccgtacggtacggttacgtacggtacgtacgtagtcggtacgttacggtacggtaacctacgttaccttaccctaccctaccgtaactaacgtacgtaacgtaccgtaccggtaacgggtaaccgtacgtaaaggtaacgttaccgtacgttaccgttaacgttaaccgtttaaaccgtttacgtttaaccgttacggttaaccgttaaaccgttaacggttaaccgtttaacccggttttaaaccgtttaacccgttaaaccgtttaaccggttaaacgttacccgtttaacccggttaaccccggttaaccccgggttaaacccgggtaaaccccgggttaaaccgggtaacccgttaaccgggtaaacggtttaaaccgggttaaaaccgggttaaacccggttaaacccggg

SEQ ID NO: 171506 - DNA, 832 bp, Homo sapiens
  misc_feature: GYAE6OF01DPH6S.27.78.H01.1.454.CMB.1.raw
  modified_base (225)..(225): a, c, t, g, unknown or other
  misc_feature (225)..(225): n is a, c, g, or t
tcagagcgtcgtctcacgaccggtgctcgatttagtgtgagtagtttggggtttggggatcttaaaagaggttctttctctgggatgtggcatgagacaaaactgacaagtcaaggcaggaagatgttgccatcacaactctatttgggtttctgctgctcgttgggttccagcctaccgaggggtagtaaattgtgctgactcacgtcctaccagtcctttacncgtcttgtacgtacctaccgaaagggtaagaacgtaccaccactaccgtaccgtcgggacccgggtaccgagtaccgaggacggtacggttaggtaacgtacgtacttaccgtacgtacggtacagcgagaacgccgaggtcgacgtactaccgaacgtcctcctactactactagtactcgtacccttacctaccgttccttaccgtaccggaccgggtttccccgtacggtacggttacgacggtcggtacgtaggtcggtacgtacggtacggaacctaaccttacccgtttaacccctaccctaccgtaaaccctataacctaacgttaccgggacccgtaagggtaacccgtcgtaacggaacgtacgttacgtacccgttacgtaacctttaactttaccgtttaaccgtgttaaccttacgtaacggtaccgttaaaccttttaaccctttaaaccgtttaccgaagtttaaccgggttactaaccccggtttacccggttaaacccgggtacccgggttaaacccggaaaaccggggtttacccgaaaccgggttaccgtttaaaacggggtaaccgttaaaacggttaaaaccccggg

SEQ ID NO: 171507 - DNA, 804 bp, Homo sapiens
  misc_feature: GYAE6OF01BR2GN.27.78.H01.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
  modified_base (298)..(298): a, c, t, g, unknown or other
  misc_feature (298)..(298): n is a, c, g, or t
tcagagcgtcgtctcacgaccggtgctcgatttagtgtgagtagtttgggttggggatgagcaaaactgacaagtcaaggcaggaagatgtgccatcacaactcattgggtttctgctgctctgggttccagcctcgagggtanaattgtgctgactcagtctcagtactttcagtctgtgactaccaaagganaagtcacatcacctgaccggcagtcagagtcggttaggtatagcttacacgttggaccagcgaagaagccaggtctagtacctacaaagtcctacctacactanaaggtatcggtaccttacccgtacgttaccctttccgtaccgggtaaccggggttcccccgttaacgggtacgggtttaccgtaacggtccgggtacgttaaacggtcggggtaaactttcggggttaacccgggtaaaccttaaaccggttaacccttttttacccgaaccccccgtttacaaaccccgttaaactaccgtaaaagttaacccgggtacccgtttaagggaaacgtacggttaacggtaaacgggtattaccggtaacctaacgtaaaccttaaacctttaacgtaaccgttagtacctaaagtcctaaagggtaactttaacctttaacgtttacccgtaagtacgttaaccgtaacgttaccgttaccccgttacgggaacccgttaaacgggaacccgtaacgaccgttaagggaattaaaccgtttaaaccggagtttccggagtaaccgtcgtaaccctaaaccttcttacgttccgtattttaccccgg

SEQ ID NO: 171508 - DNA, 635 bp, Homo sapiens
  misc_feature: GYAE6OF01B8NR6.27.78.H01.1.454.CMB.1.raw
  modified_base (187)..(187): a, c, t, g, unknown or other
  misc_feature (187)..(187): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtcctccagtactttcagtctgtnactaccgaaaggagaagtcaccatccaccgtcgccgggccagtcagagtcggttaggtagtacgtcttaaccacgtacggtaaccagacgaagaacgccgaggtcagtacctaccaaagcctcctcaatacaacgttagtcgtacctttaccccgagtttccctttccgtcgacccggggttcccctcggtacggttcaggtcggcgagttggactcgaggtacactactttccaccctacaacccgtataccaagtacgacctaggaacgtcgtagaagntcgcttagacttaactttacttactgtactataccgaagtacgttacttaacctttacaacgtatatactacctaccgttacggacgaacggccaacggtgtacggaacgtaacgttaaacgagttacgcggtacctagtaccctactagttcctgttccttacccg

SEQ ID NO: 171509 - DNA, 857 bp, Homo sapiens
  misc_feature: GYAE6OF01E2RAV.27.78.H01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctcgtgggttccagcctccgagggggacgtaaattgtgctgactcagtctccagtactttcagtctgtgactaccgaaagganaaacgtccaccatccgaccgtcggcccgggccagtcagngtcggttggtagtagcttaacncgtaggtaccagacagaacgccaggtctagtcctacgaaacgcctcctactactacgaaggttactcggtccctttacccgtacgtttaccctttccgtacccgtaccggggttcccccttaggttaccggttttaccgacgggtcggtaccggtaggttacgggtacgtacggtaccggggtaactaccgttactttaccccaacccttaccaaccttacgtaaccgtaaacgttaccggttccggtaacgggtaaacgtacggttaacgggaagtacgttccggttaccttaacgggtaccttttaaacgtttacgtttaaccgttaggttaaacccctaggttaccgtaaacggtttaaccctttaacccgtttaaccgtttaacccgttaccggtaaggtttaacctaacccggtttacccgttaacccggttacccggggaaccgtaaccgggtaacccggtaaccggttacggtaaaccgggttaaacggttaaaccgtttaaaaccgggtacgggttccggtacgggtacccttacgtaaccccgtattaacccgttcggttacccgtttccgtttaaaccccg

SEQ ID NO: 171510 - DNA, 795 bp, Homo sapiens
  misc_feature: GYAE6OF01A0C94.27.78.H01.1.454.CMB.1.raw
  modified_base (245)..(245): a, c, t, g, unknown or other
  misc_feature (245)..(245): n is a, c, g, or t
tcagagcgtcgtctcacgaccggtgctcgatttagtgtgagtagtttgggtttgggggtagtgagcaaaactagacaagtcaaggcaggaagatgttgccatcacaactcattgggtttctgctgctctgggttccacgcctccgagggtgtaaattgtgctgactcagtctccagtactttcagtctgtgacttaccgaaaggagaacgtcaccatcaccgtcggccgggcctacgtctaaggngtacggttggtagtagtaccttactacgtggtacccgagacgaaggaacgccgtacggtctacgtacctaaccgaacgtcctcctacctaacgttacgtaacgttctccgttacccttcccgtacgtttcccgtttaccgtacccgggttaccggggttcccctacggttaacggttaccgagggttcggaccggttaggtacggtacgtaccggtaacggtaccttaacgttaccttacccgtacccgtaccaccttaacgtactaaacgtaccggcgttaaggaaccgtacgtaaggtaagtacgttcccgtacgttaacgtaaccttaactttacggttaacgtacgtacctagtaacgttaattaacctttacccgtttaaccttccggaacttaacggtccgtaaccttccggtaccgtaccgggtaacccggaaaggtacctaacgtacgggttaaaggtaaccgtttaaaacggtaacccgacgggttcggtaccgtaactacccgtacccgtaacttccgttttcgttaccctcgtttaccc

SEQ ID NO: 171511 - DNA, 884 bp, Homo sapiens
  misc_feature: GYAE6OF01CRBGS.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtggttccacgcctcgagggtagtaatgtgctgactcagtcctccagtacttcagtctgtcgaactaccgaaaaggtaacgtaaacgtaccaacctaactcccgtaacccgcggaccccggggtacctagtaccgaacggtacggtaccggttaggttaaggtaaacgttaccgttaaccgaaccggttacgggtaacccgaaggaccgtaaaggaaaccgaccgtaacggtacgtaacgtacctaacccgaaaacgtccctaccgtacctaaacgtaaccgtaaacgttacggttacctaccctttccgtaaaccgtttccccgtttaccgtacccgggtacccggggttacccccgttacgggtacggtttacgaaccggggttcggtaccgttaaggttacgggtaaccgtacggttaccggggtaaacctaaccggtttaaaccgtttacccctaaacccccgtaaccctaaaccccgttaaactaaaccgtaaacgttacccgtaaccgggttaaggggtaaacccgtaaccggttaaggaacgttactaacggtacttaccggtaaaccgttaacctttaagttaaccgttacgtacgttaaactacctaacggtaaacgttacctttaacccttacgttaaaccgtagtacgtaactaccccgtaacgttaccggaccggtaagaacaccgtaagtacggtaaacgtaacgttaaaacgg

SEQ ID NO: 171512 - DNA, 836 bp, Homo sapiens
  misc_feature: GYAE6OF01AZXHP.27.78.H01.1.454.CMB.1.raw
  modified_base (125)..(125): a, c, t, g, unknown or other
  misc_feature (125)..(125): n is a, c, g, or t
  modified_base (348)..(348): a, c, t, g, unknown or other
  misc_feature (348)..(348): n is a, c, g, or t
tcagagcgtcgtctcacgaccggtgctcgatttagtgtgagtagtttgggtttggggggcgatgagcaaaactgacaagtcaaggcaggaagatgttgccatcacaactcattgggtttctgctnctcgtgggttaccacgcctccgagggggtagtaaattgtgtctgacctcagtcctaccagtactttcagtctgtcgaactaccaaaagggaacaaagtcaacctatcaccggtggcccgggtacacggtcgagtacggtcgtttaggtaagtacgtactttaaccgacgttacggtactaacgacgaagacgaccgtagggtacaggttacccaccgtaaacncccgttcctactaacttccgaaaagttaccgtacggttccccttacctaacggtttccctttaccggtccgtaaccccggggggttcccccttaacggggtacggttaccgtacgggtaccggccgttaaaggtcggtaccgtagttaccgggaaccttaacttacgttcccgaccctactaaccgaaatctaacgtacgtacgtacggaacgtctaacggtatacgtacgtacacgtaccttaaagtttaccttaggtacctttacgaacccggttaattacggtaaacttttccctttaaaaccttaaccggtttactaaacggggtttacctaaccgttaccgttaacccggggttaaccctacgggtaaaccggtaaaccggttccgtaaaaccggggttcggaaacctaaaagggttttaaccgggaacgttcgggtaacgttacgtacccgttactaacccggtatcgggtcctttaaccgg

SEQ ID NO: 171513 - DNA, 692 bp, Homo sapiens
  misc_feature: GYAE6OF01ARMDP.27.78.H01.1.454.CMB.1.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggtccagcctccgaggggtnaaattgtgctgactcacgtcctaccaagtacctttcgagttctgtacgaacctaccgaaaaggaanaaacgtccaccatccacgtcggcccggacagtcaagaggtacgttggtagtagtcttacgacgtacgtaccagacagaacgccgagtcacgtccacaaacgtcctactacatacgaagtacgtcgtaccttaccacgttccttcgtaccggtaccgggtcccttacggtaggttacgaggttacgagtacgtacggtacgtaccgtagggactaccgtacttaccccaccctacaacctactaanaacttacgacttacggagtaccgtagaacgtacgtcgtaccgtagtaaccttaaatttaccgtttactaccgtaactactaacgtaaccgttaacgttaaaccctttaaccgttaccgtaacgttaacgtacgtaaccttacgtaacccgttcggaaaccgtaaaggacccgaacgtaggaacgtaagtaaacgtaaaccgg

SEQ ID NO: 171514 - DNA, 829 bp, Homo sapiens
  misc_feature: GYAE6OF01DCFGW.27.78.H01.1.454.CMB.1.raw
  modified_base (148)..(148): a, c, t, g, unknown or other
  misc_feature (148)..(148): n is a, c, g, or t
  modified_base (154)..(154): a, c, t, g, unknown or other
  misc_feature (154)..(154): n is a, c, g, or t
  modified_base (565)..(565): a, c, t, g, unknown or other
  misc_feature (565)..(565): n is a, c, g, or t
tcagagcgtcgtctcacgaccggtgctcgatttagtgtgagtagtttgggtttgggggcatgagcaaaactgacaagtcaaggcaggagatgttgccatcacaactcagttgggtttctgctgctctgggttccagcctcgagggtanaattgngctgactcacgtcctcagtacttcgagtctgtcgacctaccgaaaaggaagaacgtccaacctactccgacccgtcgggcccgggaccacggtacaggacggtacggtttagggtaacgttacgtacctttacgaccgttacggaaccgacgacgaacgaacggacccgtaaggtccgtaacgtacctaccgtaaacgccctcctactactaacctaaagttactcgtccctttaccctacgtttcccttccgtaccggtacccggggtacccccgtcggtacggtcgaggtcggcgtagggtacgtacgttcgttacgggtaacctaccgtacgtttacccacccctttaaccacccgtaatactaaacgtccggtaccgtaacgggtaaacgtcgtaaaggtaaacggngttaccgtacggttaaccgtactttaaacctttacgttaaccttacgtacttaacgttaacgaacgtttaacgtttaacccgttaaccttttaacctaacggtaaacgttacgtacctttacccgttaaccttaccgtaacggaacccgtaaacgggaaccctaacgggtacgtaaagggttaaacttaaacggtttaaaaccccggtagttacgggaccggttacgtaacccttaccggaaacctcgttccggttttaaaccg

SEQ ID NO: 171515 - DNA, 807 bp, Homo sapiens
  misc_feature: GYAE6OF01EH8A8.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctcgaggggtnaaattgtgctgactcagtctccagtactttcagttctgtacgactaccgaaaggagtaaacgtcaccatccaccgtcggcccgggctagtcgagagtcggttaggtacgacgtcttacgacgtacggtaacctagacgtaagaacgccgagggtccacgtacctaccgaaacgtcctcctactataccgaagttactccggtcctttacccgtacgttccctttacgtccggtaccgggttccccctaggtacggttaccgagtacggaccgtaggtcggacttacggacggtaacctacgttaactttcccgacccctaccaccgtaactactaacgttacgaccgtaaggaactacggtaagaacggtacttcgacgttaacgtaaccttaacgtttaacgttactttacgtactaacgtaccgttaacgttaaccgttaccgttttaacccttaaccggtaacttaaacgggtaccttaacggtttaccccgtaacccgggtttaaccgggaacccggtaaagggtaccccgttaaacggaccgttaaagggtaaaccgttaaaaggttaaccccgggttaacggtcgggttaaccgaccggttaaccgtaccccgtaacgtaaccggtttccctttaccgtccggtttaacccccg

SEQ ID NO: 171516 - DNA, 772 bp, Homo sapiens
  misc_feature: GYAE6OF01BXLI4.27.78.H01.1.454.CMB.1.raw
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaagganaaagtccaccatccaccgtcggccgggcagtcagagtcgttggtagtacgtacttacacgtacggtaccagcgaagaacgccgaggtcacgtacctaccaaacgtcctaccgtacactacaagttctcgtccttcccacgttccttccgtccggaccggggttcccctaggtacggttaccgaggtcggcgtaggtcgtacgttcggtacggtacctaaccgttacttacccaccccgtacgaacctaactaactaaacgttaccgtaccgttagggtaaactccggtaaggaacgtacgtacggtccgttaaccggaaccttttaaaacgtttctttaaccgttaggtaacctaagttaacctaacggttaacgtttaacccctttacgtttaacccgtaacgttaacgtacgtaaccttacccgtaacccgttacgggaacccggtaaagggtaaaccgtaccggttaccgtaaagggtaaaccgtttaaaacgttaaaccggtaacgggttcggttacggtaccgtaaccgtacctaccgttaacttccgtttaccgttccgttaacccg

SEQ ID NO: 171517 - DNA, 1181 bp, Homo sapiens
  misc_feature: GYAE6OF01D98S9.27.78.H01.1.454.CMB.1.raw
tcagagcgtcgtctcacgaccggtgctcgatttagtgtgagtagtttgggtttgggatacttaaaagaggttctttctctgggatgtggcatgagacaaaactgaacaagtcaaggcaggaagatgttgccatcaacactctagtttcgggtttctgcttgccgttcgttcgggttccacgtcccttaccggaggggggttataaacgtttggtacggtccttacggtaccttacggtacgttcccgtaccggtacgttaaccttttcgacggttccgttcggttaccgtaaccttaaacccgggaaaagggtaacgtaaaccggttaccaacccgtaactacccgtaccggttaccggggaccccggtaccgtaacgtacggaacggttacgggttacgggtttaaggttaacggtaccgttaaccgttaccggtaacggtacccgggtaacctaaacggaccggtaacggaacggtaccggttaacggtaccgtaccgttacccgaaccgtaaccggtccctttaccctactaaaccgttaggttaacgttacctacgggtaccccctttaaccggttccgtttacccggtttccccgggtaaccgggggttaccccgggttacccgtttaacgggttacggttttaccggacggggtttcgggaaccggttttacgggaacggtttaccgttaacccgggtttaaccggggttaaacccctttaaaccgttttaccccccggtaaacccttaaccccggtaaacccgttaacgttaaacccggtaacgggttaaccggtaaccgggttaaccggggttaaacgttacccgggtaaacggtaaacgttaccgtttacggtaccgtttaaccgggtttaaacccgtttaactttttaaccggttaaccgttaacccggttaaccgtttaaacggttacccgggttaacttttaaaccccggttttaaccgttttaaaccccggtttaaacccgttaaacccgggtttaacccggttttaaaccgttaaaccccgggttttaacccccgggttaaccccggggtttaaacccgggtaaacccgggttaaacccggggtaaaccggtttaaacccggggaaaccgggtttaaacccgggtttaaaacgtttaaaacccgggggttaacccgtttaaacgggg

SEQ ID NO: 171518 - DNA, 663 bp, Homo sapiens
  misc_feature: GYAE6OF01BSCFR.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtnaattgtgctgactcagtctccagtactttcagtctgtgacctaccgaaaggagaaacgtccaccatccaccgtggcccgggccagtcagagtcgttaggtagtagcttacacgtggtaccagacagaacgccaggtcagtctacaagcctcctacatacaagtactgtacccttcccacgttccttccgtccggtaccgggtcccctaggttacggttcgacggtggtcgtaggtcggtactcggtacggactacgtactttccaccctacaccgtatactaacgtacgaccgtagacgtcgtagaacgtgtcgactacgtaccttaacgtttactttacgtacgtactagtacgtaagtactttaaccttacctttaccgtagttaacggtactacctacccgttaccgtaccggaccgtaacggacgtaacgtacggtacggtaacgtaaacgttaaacgaaggttcggtacgcgtaccgtacccacccgttagttccgtcgtttccgttaccccg

SEQ ID NO: 171519 - DNA, 847 bp, Homo sapiens
  misc_feature: GYAE6OF01DJ9HF.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccacgccgtccgaggggtanaaattgtgctgactctagtctaccagtactttcagtctgtcgacgtaccgaaaggacgaaacgtcaccagtccacccgtcggcccgggacctaaggtccgaaggtcggtccggttaggtacgtacgtccttacgactcggtaacagacgaagaacgccgtaggtacacgtacctaccaaacgtcctacctactaacgtacgtaacgtcgtccgtccttacccgtacgtttcccgttccgtaccgggtaccgggttaccccgttacgggtacggttacgtcgggtcggacggtaggtcggtacgttcgggacggtaacctaccgttaccgtttacccctaccctaccgaacctaacgttaccgtaaacgttaccggttaccggtaaggtaaaccgtcgtttaaagggaacgtacgttcggtaccgttaaccgtttaacgtttaaacccgttttacgttaacgttaccgttaacctaccgttaaggtaaaccggtttaaaccgttttaacccgtttaaccgtttaccgttaacggttaaccggtacctacgtttaacccgtaccggttaacccgggaccgtaaaccgggaccgttaaccggtacgtaacgggttaacctaaaaggttaaacccggtacgttacgggtacgtccgttaaccgtaccgtacccttagttttccgtaccgttcttaaccccg

SEQ ID NO: 171520 - DNA, 765 bp, Homo sapiens
  misc_feature: GYAE6OF01CX93M.27.78.H01.1.454.CMB.1.raw
  modified_base (254)..(254): a, c, t, g, unknown or other
  misc_feature (254)..(254): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggtccagtctccgaggggtgaattgtgctgactcagtctccagtactttcagtctgtagactaccgaaaggagaaagtcaccatcaccgtcgccgggcctagtcagacgcgttggtacgtagcttacncgtaggtaccagacagaacgcgtaggtcacgtcctaccgaaagtcctcctactatacaagtactcgtacccttcccgtaacgttccgtttcctacggtaccgggttcccccgtaggtacggttcgacggtcgacgtacggtacgtacgttacggtacggtactaactaccgtttaccaaccccttacaaccgtaactactaaacggtaccgtacgtaggaacgacgtagaagtactgacctagtaacgtaactttacgttactcgtacgactcgtaacgtacggttaaccttaccgttaacctaacgttaacggttactacgttacccgtaaccggttaccgggtaccggtaaaccggacgtaaccgggtaaaccggtttaagggaaaaccgggttaaacgtttaaaacccgggtaaacggtttacccgggttaaaccggttaccggtaccggtttaaccccgtaaaccgttcccttttaaccgttaccgggtttcccctttaaaccccgg

SEQ ID NO: 171521 - DNA, 675 bp, Homo sapiens
  misc_feature: GYAE6OF01BKMND.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactctagtttgggttctgctgtctcgtgggttccagcctccgaggggtagaattgtgctggactcgacgtctccagtacttcagtctgtcgactaccgaaaggacgaaactcaacctactccaccgtcggccggcagtcaggacgtcggttagtagtatccttaacgacgtacggaccaggtacaacggaacgccgaggttctaagtacctaccgaatccctcctacgactaacgaacgttctcgtaccccttccgtaaccgtccttacccgtacggttacccgggtccccgtggttacgttacgtagtggtacgtaggtcgtacggtacggtacggtaacctacgttaaccttcccaaccgtaccaaccctactacgtacacggtcgagtacgtacgagtacgacgttacgactatacctaacgtttataccgtagctatagtaacgttctaacgtttctttacccagttagtacacccgttaacgtcccggtacggaacgtaaccggtctaacggagtaacgggtaactaacgtaacg

SEQ ID NO: 171522 - DNA, 706 bp, Homo sapiens
  misc_feature: GYAE6OF01DP02Q.27.78.H01.1.454.CMB.1.raw
  modified_base (499)..(499): a, c, t, g, unknown or other
  misc_feature (499)..(499): n is a, c, g, or t
tcagagcgtcgtctcacgaccggtgctcgatttagtgtgagtagtttggggtttggggggcatgagcaaaactgacaagtcaaggcaggaagatgttgccatcacaactcattgggtttctgctgctctgggttccagcctccgagggggtagtaaattgtgctgactcagtctaccagtactttcagttctgtgacctaccgaaaggaagaaacgtcaaccatccaccgtcggcccgggcagtcaggaggtcggttggtagtactactaactacgtaggtaccagacgaagtaacgcgtaggtacgacgtccaccaaacggtcctacctacaataccgtaagttactccgtccttaccctcgttcccttcgtaccggtacccgggtaccccgtggtacggttcgaggtcggacgtagtcggtacgtcggtacggaactactacttcccgaccctacaacctacgtactacgtacgaccgtaggtacacgtagaacgtntcggtactgtactttaacgttcttaacgtcgtacttagtacgtaacgttaaccttaacccgtttactttaacccgtactaaacggttcctaacttacccgtacccggttacggaccgtaaacggtcgaaaccggtacgtacggtaaaactaacggtaaacggtactacgggttacacgttaccacctagtaccttcgttcgttaccc

SEQ ID NO: 171523 - DNA, 963 bp, Homo sapiens
  misc_feature: GYAE6OF01DEN5D.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctcgtgggttccagcctcgagggtnaagttgtgctgactctagtctcagtctttacgagttcgtgtacgacgtaaccgaaaaggtagtaaacgtccaaccgtactaccgtacccggtacgggcccgggtacgacggttaccgagggttaacggttaccggtttagggttaaacggttacggttacccgtttaaacgtaaccggtttaccggaaacccgtaggtaaccgaaaggaaccggtaccggtaacggttacccttaacggttaccctaaaccgtaaaccggtccgttaccccgttaactaacttaaccggtaagtttaccggtaccttacccgtttaccccgtaacgttttccccgttttaccggacccggggttaaccgggttcccccgttaacggtaaccgggtttaccggtagggtttccggaacggtttacggtaccgggttaacgtaccgggtaacggtaaccttaaccttccgtttaacccgacccgtacctacgtaccttaagaacgttacggtacccgtaagggtaccgtagttaacgactaaacgttcggtaccttaggtaacctttaaccgtttagtaaccttcggaaaccttacgtacgtaacgttaaccgttttaaccgtttaccttaaacgggtcctaaacggtacccgtttaaaccgtaccccgttaccggttaaccgggtaaacccggtacggtaaaaccgttaaccgggtaacggttaacgggtaaaccgtttaaaccgggttaaacggtacgggttaccgttaccggaaccgttaacccgaactttacccccggtatttcccgggttctttaaaccccg

SEQ ID NO: 171524 - DNA, 762 bp, Homo sapiens
  misc_feature: GYAE6OF01CGEHP.27.78.H01.1.454.CMB.1.raw
  modified_base (153)..(153): a, c, t, g, unknown or other
  misc_feature (153)..(153): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgngctgactccagtcctccagtactttcagtctgtgacctacgaaaggagaaacgtcaccatccaccgtcggacccggctagtcgaagngtccggttaggtagtactcttaaccncgtaggtaccagacgaagtacgccaggtcagtccaacgaacgtcctacctcacgtacaagtctaccgtccgttcctaccgttcctctcgggtacccgggtcccttacggtacggttcgagtcggtcgtaggtacggtacgtcgacggaacctacttaccgtttcccaaccccttaccaaccgtactaaccgtaaccgtacggtacccgtagggtaacctagtaacggaactgtcggtaactacgtaaacctttaatttactacgttaacgtactaagtaccgttaagttacccgttaaaccttttccgtaacctagtaacggttcgtaaccgttacccggttacccggtaacggtacccggaaagggttacccctaaacgggacgttaaaccggaaacggtttaaacggtaaaacccgggttacggttaagggtaccccgagttaacccggaacccttaacgtacccgttaccggttgtttcccccgttaaacccg

SEQ ID NO: 171525 - DNA, 835 bp, Homo sapiens
  misc_feature: GYAE6OF01DRRF8.27.78.H01.1.454.CMB.1.raw
  modified_base (156)..(156): a, c, t, g, unknown or other
  misc_feature (156)..(156): n is a, c, g, or t
  modified_base (662)..(662): a, c, t, g, unknown or other
  misc_feature (662)..(662): n is a, c, g, or t
  modified_base (805)..(805): a, c, t, g, unknown or other
  misc_feature (805)..(805): n is a, c, g, or t
  modified_base (826)..(826): a, c, t, g, unknown or other
  misc_feature (826)..(826): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcgagggtgaattggtcncgtcgactcacgtctaccagtacttcgagttctgtacgaccgtaccgaaaagggaagtaacgtaccacctactaccgaccgtcgggcccggacctacgtacgaggtacggtcggttaggtacgtacgtaccttacgtaccgtacggtaccgaacgacgaacggaaccgtacgtaacggtactacgtaccctaacccgtaacgtacccttacccctaacgtaacgttaccgaaacgtttacgtacccggttaccccttacccttaaccggttttccccgttaccggttaccccgggttaccccggggtttacccccgttaacgggttaaccggttccgtaacgggttccggtacgtacgggttacggtacgtacgggttacgggtaaaccctaacgttaccctttacccgaccccttacgtaaaccgtcttaaaccgtaacgtaccggtacgtacggaaagttcggagtaaatcggtaactcgtacgttaaacttactttacgtctntacgaacttacgtaacggttaacttacccgtttaaaccttacgtactaagggtccttaccgttacgtaaccccggtacggaacgggtacgaacccggttagaacggttaaccgaaggttaaaccttaaacggcgtttaggacncgtacgtactacgtccgtttntacccgttc

SEQ ID NO: 171526 - DNA, 784 bp, Homo sapiens
  misc_feature: GYAE6OF01BUUWM.27.78.H01.1.454.CMB.1.raw
  modified_base (181)..(181): a, c, t, g, unknown or other
  misc_feature (181)..(181): n is a, c, g, or t
  modified_base (234)..(234): a, c, t, g, unknown or other
  misc_feature (234)..(234): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtanaaattgtgctgactcagtctaccagtactttcagtctgtgactacgaaagganaaacgtcaccatcaccgtcgccggaccagtcagtagcgttaggtagtacgtcttacacgtcggtaaccagacgaaggaacgtccgaacggtaccgtacgtacctaccgtaaacgtcctacctactaacgtactaacggttacaccggttccttacccgtacgtttcccgtttacggttacccgggtaacccggggtttcccccttacgggttaaccgggtttaccggtaaacggggtttccggggaacctaaacgggggttggtaaacctttaccgggttacggggtaaacccttaccgttaccgtttaccccaaacccccgttcccgtaaaccctaacgtaaccgtaaacgttaacccggaccgttaacgggtaaccgtacggttaacggaacgtacgttaccgggtacttacgggaaaccttaaccgtttattaacccgttcgttaactacgttacgtacgttaacgttaaccttaaccgttacctacgtaacgtacgtactaccgtccttaccggacgacgtacgacgagtaggataacgtaaacgg

SEQ ID NO: 171527 - DNA, 856 bp, Homo sapiens
  misc_feature: GYAE6OF01DFFG0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctcgaggggtgaattgtgctgactcagtcctccagtactttcagtctgtgacctaccgaaaggagaaacgtcaccatccacctcggccgggccagtcagcggtcggttagggtagtacgtccttaacgacgttcgggtaccacgacgaacggaacgaccgaggtaccacgtaccgtacccaaacgtcctccctcatacgtaagtctcgacctttccctacgttccctttcgtccggtaccgggttcccccgtaggtacggtcgaggtcggtacgaggttggacgtaccgtacgggtacctaacgttactttccccgtaaccctccgtaacctaacgtaaccgtaaacgtaccggtaccgtaacgggtaacgtacgtaagggtaacgtaacgttacggttacctaacggtaacccttttaaaccgttttaacgtttaccgttacggttacccttaaggttaccgttaaacgttaacccgttttaacctttttaaacccttttaaccgtaaccgttaaacggttacggttaccgttacccgttaacccgggtttaacccgggaacccggttaaacgggtaacccccgtaaacggtaaccgggttaacgggtaaacggtttaaaacccggtttaaaaccgggtaaccgtttacgggggtacccgtacgtacccgggttaccctaaaccggttaccgtttaccgttacccgtttcggtttaacccc

SEQ ID NO: 171528 - DNA, 750 bp, Homo sapiens
  misc_feature: GYAE6OF01ALJNS.27.78.H01.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttggggatgagacaaaactgacaagtcaaggcaggaagatgttgccatcacaactcgattgggtttctgctgctcgtgggttccacgtccgtcgaggggtagtaaagttgtggtctagtactcacgtctacgtacttcttacgngttccgtgtacgtacctaacggaaaggaacgtaacgtaccacacgtcccgtacgccggccgggcctagtcgagtcgtacgggttagtaggtacgttactaccgtaccgtacggaaccgngacgaacgtaaccggaccgtacggtactacgtaacctaacctaactccgtccttaccgtagtaactaacgttacttcccgtaccttccgttacccgtttaccgtccggtaccgggtccccgggttacccgtacgggtagtccggtagtcgacggtcggtagtccgtaggacggtaacnccgtttcccgacctacctacccgagaccgtactacggtacgtacggtacgaacgtagtaagactacgtactcgtaactacttaccgttaatcgtacgatatacgtaattacccttaacggttactaactaagtacgtagttacccctacgtaccggtacgtacgaaccgtacgtacgaaacggttcgaaaacgttacggaacggtacgttggaaccggtactaaccggtacttacgtaacttcttccgttacgttccc

SEQ ID NO: 171529 - DNA, 602 bp, Homo sapiens
  misc_feature: GYAE6OF01A1A43.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattggggtttctgctgctctgggttccagcctccaggggtgaaattgtgctgactcagtctccagactttcagtctgtgactcaaaggagaaagtcaccatcacctcgccgggccagtcaggagtcgttggtagtagcctttacgactggtaaccagcagaagccaggtcagtctaccaaagtcctcctacatcaagtatcgtcctcccagtccttcctcgacgggtccctcgtagtcagtggcaggtgatctcgggacactacttccaccctcaccactacaactacgaccgtaggaacgtcgtagaagtatcgtacgtcgactaacctttaattaccgttagtactacgtaccgtaagtaacttaaccgtttaactttaaccctacgttaacggtagtacctactaccgttaccggacccgtaagggaccgacgtacgtaggtacgtaaacgttaaaccgtactaggcgactacgcctactatcctgttctacc

SEQ ID NO: 171530 - DNA, 737 bp, Homo sapiens
  misc_feature: GYAE6OF01C0QF0.27.78.H01.1.454.CMB.1.raw
  modified_base (716)..(716): a, c, t, g, unknown or other
  misc_feature (716)..(716): n is a, c, g, or t
tcagagcgtcgtctcacgaccggtgctcgatttagtgtgagtagtttgggttgggggcatgagcaaaactgacaagtcaaggcaggaagatgttgccatcacaactctagttgggtttctgctgctctgggttccagcccgtccgagggtgtaattgtgctgactcagtcctctagtactttcagtctgtcgacctaccgaaaggtaagtaaacgtccaacctactccgtacccgtcgggacccgggacctacggtacgaacggtacgggttcgggttttacgggtaagttacggtacctttaaccgtaccggttcggtaaccgacgaacgtaacggaacgaccggtacggtactacgttccaacctaacgtccctactacaataccgtaagttcgtcgtacccttcccgtacgttccttccgtacccgggtacccggttccccgtaggtacggtctaggtacggtacgttaggtgtacgtgtacggacctacgttaccttacccaccctacgtacctactaacacgttcgtacgtaacggtaagtacgtaaggaacttagtcgtaccgtagtaaacctttacttaacggtttatacctataccggttaactaacggttaacctttaacctttaaccgtacttacgtaactcgtacctaccgtaccgtacgaacggaacgtccacggtagtacgaaataacgtacgtgtcgacctnaccgactatccgtcttcgtcc

SEQ ID NO: 171531 - DNA, 906 bp, Homo sapiens
  misc_feature: GYAE6OF01D9JBR.27.78.H01.1.454.CMB.1.raw
  modified_base (180)..(180): a, c, t, g, unknown or other
  misc_feature (180)..(180): n is a, c, g, or t
  modified_base (201)..(201): a, c, t, g, unknown or other
  misc_feature (201)..(201): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgcttgactcagtcnccagtactttcagtctgtcgactacgaaaggagaaacgtccaacctatcctaccgtcggccgggcctaggtcagggtacgtcggttagtacgtacgttactacgtacgtacgtaacgacgacgaacgggaccgtaccggtacggttaccgtacgttaacgtaccggaaaccgtcccttaccgtactaaacgttacgtaaacggtttactacccgttaccctacccggttacgtttacccgttccgggtaaccggttccccgggttacccgtacgggtttacgggtaccgtacgggtacgggttacggtacggttacggaccggttacggtaccggtaacttaccgtttaacccttcccgtaacccctactaaactaaccgtaaccttaacgggtaccgtaccgggtaagtaccgttaacggagtaacggttccgtacggtcttaaccgttaaccgtttaacgtttacgttaaccggtttaccgtaagtaccgttaacggtacccgtttaaacgttaaccccgttttaccgttaaaccggttaccgtttaaaccggtaacgttttacccccggttaaacccgggttttaaccccgggaaaaccggggttaaaccccgggttaaaaccgggtaccccggttaaaaccgggttaaacccggggttaaacggttaaaaaccgggtttaacccggttaaaaaccccgggg

SEQ ID NO: 171532 - DNA, 872 bp, Homo sapiens
  misc_feature: GYAE6OF01CMP86.27.78.H01.1.454.CMB.1.raw
  modified_base (626)..(626): a, c, t, g, unknown or other
  misc_feature (626)..(626): n is a, c, g, or t
  modified_base (731)..(731): a, c, t, g, unknown or other
  misc_feature (731)..(731): n is a, c, g, or t
  modified_base (779)..(779): a, c, t, g, unknown or other
  misc_feature (779)..(779): n is a, c, g, or t
  modified_base (788)..(788): a, c, t, g, unknown or other
  misc_feature (788)..(788): n is a, c, g, or t
tcagagcgtcgtctcacgaccggtgctcgatttagtgtgagtagtttgggtttggggatacttaaaagaggttctttctctgggatgtggcatgagacaaaactaaacaagtcaaggcaggaagatgttcgcatcacaactcagtttggttctgtctcgtctcgtcggtccacgtccctcggtaagggtagtaaattcgtgtctcgactcgtacgtctaccgtacgtacctttcgcgttcgttacgtaccgtaaccgtaaaccggaaaacggtaacgtaaaccgtacctaacccgtaaccgttaccccgtaacccgggttcccggggacccccgggtaccgttaacgggttaccggaacgggttaaaccggggttccgggttttaacggtaacggtttaacccgttacccgtttaacccggtaaccggttaccggtaacccgtaccgaacggtaaaaccggtaccggtaccggttaaccggtaccttaaccgttaaccccgtaacctaaccggttcccttaacccgtacgtaacgtaacggttaacgtacttcccggtaccctttaccgtccgtttcccgttaccgtaccgggttcccggtacccgttggcgttccggtagtccgngtaacggtcggtaccgtcgggtagaccttaccttacctaccaccgttacactataaccgtacgtcgtacgacgtaacgtgaacgtgccgttgacttactacgttnttaactacgactacttaacgaccgtttaagactttaaccttacccgtntaaaccgtnaaccggtccttacccggaccgttacggaccggtaaaccgtaccgtaacggtacgtaaacggttaacgtaccgttaaacggtcgg

SEQ ID NO: 171533 - DNA, 774 bp, Homo sapiens
  misc_feature: GYAE6OF01ARD5U.27.78.H01.1.454.CMB.1.raw
  modified_base (117)..(117): a, c, t, g, unknown or other
  misc_feature (117)..(117): n is a, c, g, or t
  modified_base (147)..(147): a, c, t, g, unknown or other
  misc_feature (147)..(147): n is a, c, g, or t
  modified_base (583)..(583): a, c, t, g, unknown or other
  misc_feature (583)..(583): n is a, c, g, or t
  modified_base (620)..(620): a, c, t, g, unknown or other
  misc_feature (620)..(620): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttcngctgctcgtgggttccagcctcgaggggtnaaattgtgctgactcacgtctccagtactttcagtctgtcgacctaccgaaaagggtacgaaacgtcaaccacgtaccacctcgggccccggggtccaggtcaggacgtccggttagggttagtacgtccctttaacgaccggttacggtaccaaggacgaacggaacggaccgtaccgggttaccaacggtcctaacccgaaaacgtcctacccctactaactaccgtaaacgttcgtacgtcccctttcccgaccgtttccgttcccgttacgggaacccggggtttcccccgtacgggttaacggttcgacgggttacgggtacggtacggtagggtcttacgggtcggtaaccctacttaccgtttacccgtacccctactaaacctaaccgtactaactaccggtccgtacgggaacgtcgtagaacggtntcgtacgtacgtacttaacgtttacttactatactanacgtaatacttaccgttactttacccaagttacgtacttactacccgttacggttacccggaaccgtacgggaactccgggtaaccgtagggtaacttaaacgtaacgtaacgtcggcggtactccggtactactaccttctttcgtccgttac

SEQ ID NO: 171534 - DNA, 918 bp, Homo sapiens
  misc_feature: GYAE6OF01ELLUU.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactctattgggtttctgctgctcgttgggtccagcctccgaggggtgtaaattgtgctgactctagtcctccgtagtactttcgtagtcgttgtgacctaccgaaaagggaacgtaaacgtccaaccactaccgtacccgtcgggaccccgggacctacggtccgaaggtacggtcggtttaggtacgtacggttaccttaacgaccgttacggtaaccgaacggtaccgaaacggaaccggtaccggtaacgggttacctaacgggttaccctaaccggaaaccgtcccttaccctactaacttaacgtaaacggttacttacccgttacccgtttaccccgtaaccggtttcccgttccgggttaccccgggttaacccgggggttccccgtttaaccgggttacgggtttacggtacggggttaccgggtacggttaacggggttcggtaacggtttccgggtaacggggtaaccttaacccgtttaacccggttttaccccacccccgtttaactaaccccgtaaacttaacgtaaaccgtaccgtaccgggtagtaacggtccgtaaggtaacgtcgttacgtaccgttagtaacccttttaaacgttcgttaacttcggtaaactccgttaacgtaacggttacttaaacccttttaccgtaccgttaacgtacgttccggtaactttcccggtaaccccgggttaccggaacccgtaaaccgggtacctaaaccggtaggggtttaaacaaacggttaaacccgttaaaaccgggg

SEQ ID NO: 171535 - DNA, 779 bp, Homo sapiens
  misc_feature: GYAE6OF01B33LH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagaattgtgctgactcagtcctacctagtattttcagtctgtacgactacgaaaggagaacgtcaccatccaccgtcggccggccagtacaggtacgtcgttaggtagtacgacttacgacgtacgtaccagacgaagaacgaccgaggtactaggtaccaaccgaaacgtccctacctacgtactacgaaaggttactcgtaccctttaccccgtacgtttcccttccgtaccggtacccgggttccccctagggttaccggttcgtaagggtcgacggtacggttaggtactcgggtacgggacctaaccgttacgtttacccaccccgtacaacctaacgttacgtaaaccttacggaccgtaaggtaccgagttagggaacgtgttacgtacctaacggtaccttaaaaccgttttacttaaccgttactaccttaacgttacgaacgtttaactttaaccctttaactttacccgtaagttacgtaacttacccgtaacccgttaccggtacccgggaacgaaccggtaaccgtaacggtacgtaacgggtaaacgttaaacgttaaccggacgttggtaccggtcctacgtaaccccagttaccgttcgtaccttccgttaacccg

SEQ ID NO: 171536 - DNA, 763 bp, Homo sapiens
  misc_feature: GYAE6OF01BEANZ.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactctatttgggtttctgctgcttcgttgggttccacgccctccgaggggtagtaaattcgtgctgactcagtcctccagtactttcagtctgtacgacctaccgaaaggagaaacgtccaacctatccaccgtcggaccgggaccaggtcgaggaggtcggttagggtacgtacgtacttaacgacgtacggtaccagacaacgacgtccgacggtcacgtcctaaccgaacgtcctaccgtactaactacgaaacgttacgtccgtacccttacccgtacgtttacccgttacggttacccgggtaacccggggttccccgttacgggttaaccggtttaccggaacgggttcgggtacggtacgggttacgggtacgttaccgggtacggttaacccttaccttaccgtttaccccgaaccccgttacccaacccgttactaacccgtaacgttaccggaccgtaggtaacgtacgtaggaacgtacgtcgacgtagtacctaaccttagttacgtacgtactactacgtactaacgtacctttaccttacctagtaacgtcttacgtacccgttaccgtacgaccggaacggtcacggtaagtaacggtaactaacgtaaacg

SEQ ID NO: 171537 - DNA, 774 bp, Homo sapiens
  misc_feature: GYAE6OF01AGBSL.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgaggggtnaaattgtgctgactcagtctccagtactttcagtctgtgactacgaaggagaacgtcaccatcgaccgtcggccgggaccagtacgaggtacgtacggttaggtacgtacgtacttacgactaggtaccgaggcgaagaacgcgaaggtctagtactacccgaaagcctacctatacgtacgtaagtactccgtacccttaccgtacgttccttccggtaccggtaccgggttcccccgtaggtacggttcgaaggtcggcgttaggtcggtactcggtacggaactaccgtacctttaccgacccccgtaccgaacgttaacttaccgaacgtttccggaccggttaacgggaacgtccgttaaggaagtcgttaccgacttacgtaacctttaatttacgtttaccgtagtacctacgttagtaacggttaaccggttaacctttaaccgttacccgtaaggtaacggttaccgtaccgttaacccgttacccggttacccgggaacgggtaaccggggtaaccctacgggttaaacccgtagggaaaacgttaaccggttaacggacggttacggcccggtactcccggtaactaccttaccggtctttaacggcctttaacccg

SEQ ID NO: 171538 - DNA, 906 bp, Homo sapiens
  misc_feature: GYAE6OF01CFVY3.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactctattgggtttctgctgctcgtcgggttccagcctccgaggggtgaaattgtgctgactcacgtcctcctagtactttcagtctgtcgactacgaaaggagtaaactccaccactccaccgtcgcccggactagtacaggtgtacggttaggtagtacgtacttacacgtcgtaccagacaaggacgccgtaggtctacgtacctaccgaacgccctacctacacttacgtaacgttagtccgtacccttaccccgttacttcccggttttaccggtacccgggttaccccgggggtttacccccgtacgggtttaccggttaccggtacgggtacggtcggtacgggttccggggtacgttaccgggtacggggtaacccttaccgttaccttttaccccgaaccccttaccgaacccttaataaccgtaaacgtacggtaccggtaacgggtacgtaccgtaggtaacgagtcgtacgttacgttacctttaacgttttaacgtacttcgtacgtaacgttaccgtaaacgtttaaccgtttaacccgtttttaaccttaacccgtaacgttagttaacccggttaaacccttacccggttaacccggtaccgggaacccggtaaaacgggtaccccgttaaacggggaaaccggttaaacgggttaaacgttaaaaccccggggtttaaagggtaacccgggtttgggaacccgggtttacccgttacccgggttaaaccccgtttacccgtttacccggttttcccgtttttaaccccggttaccgttttacccccg

SEQ ID NO: 171539 - DNA, 736 bp, Homo sapiens
  misc_feature: GYAE6OF01BK4QN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaagtcaccatccacctggccggcagtcgagagtcgttaggtagtgacttacacgtaggtaccagacagaacgccgaggtcacgtacctaccaaacgctacctcatacaacgtatcgtaccttccctagttcccttcgtaccgacccgggttcccccgttacggtacggtttacgtaacggtcggaccgtaggttacggattccggttacggggaacctaaccgttaacgtttaccccaaccccgttcccaaaccctaacttaacaaaccgttacgtacccgtaagggtaactcggttaacgaacggtatcggactacgtacctaaacttttacgttactcgtaactatccgtaacgtaacgttaaccgtttaactttaccgtaacgtaacggtactaccgttaacccgtaccgtttaccggaccgtaaacggaccgtaaccgtaacggtacggtaaagtaaccgttaaaacgtaccggttcggtacgtacccgtaaccgggttacccacttacttccggtttaagtcccttaaccccg

SEQ ID NO: 171540 - DNA, 795 bp, Homo sapiens
  misc_feature: GYAE6OF01B4C9N.27.78.H01.1.454.CMB.1.raw
tcagagcgtcgtctcacgaccggtgctcgatttagtgtgagtagtttgggtttggggatgagcaaaactgacaagtcaaggcaggaagatgttgcatcacaactcagttgggtttctgctgctcgtggttccagcctccgagggtagtaaagttgtgctagactctacgtcctacacgtactttcgagtctgtcgacctaccgaaaggaagaaacgtaccacctactccgaaccgtcggcccgggaccgtagtacgaggtagtcggtttaggtacgtacgtacttacacgtacggtaaccaaggacgaacggaacggaccgtacggtacgaacgttaccgttaaccaaacgtcctaccctacacgtaacgtaaggttacgtccgttaccccgttacccgttaccggtttcccgtttaccgttccgggtaccccggggtttaccccgttaccgggtaccggtttccggacgggttacgggtaccgtaggtacgggtaacgttcggtacgggtaacctaaccgtttacctttacccgtaacccctaacctaccgtaacgtacctaaacgttaccggtaccgtaggtaacgtacctaaggtaactagtcgacgttaccgtaacttaacgtttacttacgtctacgtatacgtacgtaacgtttaccttacttaccgtagttaacgtacgtacgttaccgccgttacgacggaacggactaccgtaaagtacgggaactaacggtaaacgtaggtcgtacggtctaccgtactaaccgttgtccttgttaccgttaccg

SEQ ID NO: 171541 - DNA, 796 bp, Homo sapiens
  misc_feature: GYAE6OF01C63KD.27.78.H01.1.454.CMB.1.raw
  modified_base (302)..(302): a, c, t, g, unknown or other
  misc_feature (302)..(302): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactaccgaaaggagaacgtcaccatcacctggccgggccagtcagagtcggttaggtagtagacttacacgtcggtaccagcaagaacgccgagtcagtctaccaaagctcctnatacaagttatcgtaccttcccgagttccttcgtcgtacggggtcccctgtacggttacaggtcgctaggtggtatcgtagggactactactttacccgaccctacaacccgtaatacctaagtaccggtaccgtacgggaaacgtaccgttaaggaaacgtacgttcggtccgttaacggtaccttaaaccgttttactttaaccgttacggtttaccctaagtttaacccggaacggtttaaaccgtttaaccgttttaacccgtttttaaccccgttaacggttaaaccggtttaggttaaccctttaacccggttaaccccggttttaccgggaaacccggttaaaaccgggggtacccctaaaaccggggtaccgttaacggggtaaaaccgttaaaccggtttaaaaccggtaaccgtttacggggtaaccgtaccgtaacccggtacccgttaaccgttaccctttggtacccgtttttaaccccgg

SEQ ID NO: 171542 - DNA, 751 bp, Homo sapiens
  misc_feature: GYAE6OF01BR5GZ.27.78.H01.1.454.CMB.1.raw
  modified_base (573)..(573): a, c, t, g, unknown or other
  misc_feature (573)..(573): n is a, c, g, or t
tcagagcgtcgtctcacgaccggtgctcgatttagtgtgagtagtttgggtttggggatcttaaaagaggttctttctctgggatgtggcatgagcaaaactgacaagtcaaaggcaggaagatgttgccatcacaactcattgggtttctgctgctcgtgggttccagcctccgaggggtgaaattgtgctgactcagtctccagtactttcagtctgtgacctaccgaaaggagaaacgtccaacctatccaccgtcggcccggcctagtcgagacggtcggtttagggtagtagtccttaacacgttaggtacccaggacgaagaacgccgagtcacgtctaccgaaagtcctcctactatacgtaagttcttacgccctttacccgtacgtttcccctttaccgtccggtacccggggttaccccctcgggttacggtttccgaaggttcgggaccgtaggttacggacgttcggtacggggtaaccttaccgttaacctttccccgaaccccttccgaaccctagtaccctaaacgttcggtaccgtaggtaacgacgtaggaacgtntacgtccgtagttaaccgttaactttacgttaccgttgtaacctacgttaccgacgttaacttaaccgtttaccttaaccgttactaaacggttctaaccgttaccgtacccggttaccggtacccggtaaaccggtaccgaacggtaacgtagggtaaaacgttacggttaaaacgg

SEQ ID NO: 171543 - DNA, 839 bp, Homo sapiens
  misc_feature: GYAE6OF01BADP2.27.78.H01.1.454.CMB.1.raw
  modified_base (292)..(292): a, c, t, g, unknown or other
  misc_feature (292)..(292): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgcatcacaactctagttgggtttctgtctgctcgttcgggttccacgtcctccgaggggtagtaattgtcgtcgtcgactctacgtcctaccgtagttacttcgtagtcttgtacgactaaccgaaagggataacgtacaccatccacgtcggccggaccagtacncggagttcggttaggtacgtacgtaccttaccgtacggttacgaaccgagacgaaccggaacgccgtaagtccgtaacgtacccttaacgaacgtccttacctactaaggtacctagtacgtccgtaaccctttccgacgtttcccttcggtaccgggtacccggtttcccgtacggtacggtttacggaggttcggacggtacggttacggtacgttacgggtaccgggttaactacccggtttacccgttaccctaacccctccgtaacttaccgtaacgtaaacgtaaccgggtacccgtaagggggaacttacggtaacgaacggtcgtttaaccgacgtttaccggttaactttaaaccgtttcttaaccggttacgtaaacttgaacccggtttaataaccttttaaccggtttaccttacccgtaaagggtttaccttacgaccctttaacccgggtttacgaaacggggtaaccccggttaaacggaccgtaacgggttaaaccggtaaacggtttaaaccgaaaggtttaaacccggg

SEQ ID NO: 171544 - DNA, 775 bp, Homo sapiens
  misc_feature: GYAE6OF01A63HJ.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaagggacgaaagtccaaccactccaccgtcggccggccagtcgaggtagtcggttaggtagtacgctttaacgaccgtaggtaaccagtaccaaggaacgccgaacgggtacaacggtcctaaccgaaacgccttacctactactacgaacgttactcggtacccttacccgtacgttccctttccggtaccggtacccggggttccccctacgggtacggttaccgtacggtacggaccgtaggtcggtacgtacggtacgggtacctaccgttactttacccgtacccctaccgaacctaactaccgtaaacgttaccggaccgtaggaacgtcgtaaggtaacgtacgtcgtaccgtacgtaacttaacgtttacttacgttacgtactagttaccaagttacctttaccttaacctttaccgtagtaacgttacgtaccttaccgttacccggtaacggtacccgaaggtaccccgtaaggtaccggtaaggtaacgtaaaccgttaaacgtacggttcgggttacggtacctaacggtaccctacgttaccttcgttccgtttaccgttacccg

SEQ ID NO: 171545 - DNA, 686 bp, Homo sapiens
  misc_feature: GYAE6OF01BAONE.27.78.H01.1.454.CMB.1.raw
  modified_base (200)..(200): a, c, t, g, unknown or other
  misc_feature (200)..(200): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgactgactcagtctccagactttcagtctgtgactaccgaaagganaagtcaccatccacctcgccgggccagtcagagtcgttaggtagtagaccttacacgtcggtaccagacaagacgccaggtcacgtacctacaaagcctcctacactacaaggttctacggtccttaccccgtaacgttccctttcgtaccggtacggggttccccctcgggtacggttcaggtcggacacggtggtacgtcggtaacgggacctaacgtacgtttacccaaccccgtacaaccgtaatacgaacttacggtaccgtaggtaacgtaccgtagtaaacggtatcggacgtacggtaaccttaacctttagttacctagtacctagtacgaagttaaccgttaccttacgtttaccaagtacgtaccgtactacccgtacgttccggaaccgaacggacccacggtactacgggtaactaaacgttaaagaacggttcggtacgactacgacccacttagtcttcgtaccttacccg

SEQ ID NO: 171546 - DNA, 810 bp, Homo sapiens
  misc_feature: GYAE6OF01AKOC1.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgtaaattgtgctgactcagtctccagtacttcagtctgtcgactaccgaaaggaacgtaaagtcaaccactacctaccgtcggacccgggacctacgtcgaaggtacgtcggttaggtacgtacgtacttaccgtaacggtcggtaaccgacgacgaaggacgccgtaaggtcaacgtcctaccaaacgtcctcctacatacgaagtactcgtccttaccacgttcccttcgtaccgtaccgggttcccctcggtacggttcaggtcggacgtgggtacgtacgtcggtaggtacctaacgtacgtttacccaccctaccactaacgtaacctaacggtacgtaccgtaacgggtaacgtagtaacggtaaatacgttctacgtacgttaaccgttaactttacgttacgtacgtacgtacttaccgtaaggtaaccttttaaacgtttaccctttaaaccgtacgttaacggttacgtaacccttaccgttaacccggttacccggaaagggtaaacccggtaccgttaaaaccgggtagtaaacgggttaaaacgggttaaaccgttaaaaccgggtaaaccgtttcggggtaccccgttacgttaacccggtaaccccgttaaaccttccgttttacccggttaaccgtttaaccccg

SEQ ID NO: 171547 - DNA, 890 bp, Homo sapiens
  misc_feature: GYAE6OF01DAI9Y.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcacaactcatttgggttctgctgctcgtgggtccagcctccgaggggtataagttgtgctgactcacgtctacctagtactttcgagttcgtagtacgtaaccgaaccgaaaaaggaacgtaaaactaccaacctactaccgtaccggtcggacccgggactacgtaccgaaggtaggttcggttaggtacgtacgtacttacgacgttacggaaccaggacgaaggtacgacgtacggtactacggtaccacgaaacgtcctacctacaacgtaacgaacggttactaccgtcccttaccctacgtttcccttaccgtccggtacccgggtcccgtacggtagttacgacgggtacgcggtaacgtagggtactacggtaacggtactacttaccgtttacccaaccctactaaacctacgtaactaaacgtccgtaacgggtacggtaacgttaccggtaagtaagtaccgtacggttaaaccgttaacgtaaaccctttaaacgttttaaccgttaccgtaaccttaacgtaaactttaccggttaaacggttaaacccgttttaaacccgttttaacccttttaaaccggtaaacgtttaacgggttaacccttaacttaaccccgggttaacccggttaaccggggtaaaccggaaaccgggttaaccgaaacgggttaaccggtaaacgggtaaaacgttaaaaccgttaaaccggtacggttaccggttacgggtccctaacggtacctaaccggttacttccggtttaactccccgtttaaac

SEQ ID NO: 171548 - DNA, 676 bp, Homo sapiens
  misc_feature: GYAE6OF01C92TX.27.78.H01.1.454.CMB.1.raw
  modified_base (131)..(131): a, c, t, g, unknown or other
  misc_feature (131)..(131): n is a, c, g, or t
  modified_base (183)..(183): a, c, t, g, unknown or other
  misc_feature (183)..(183): n is a, c, g, or t
  modified_base (448)..(448): a, c, t, g, unknown or other
  misc_feature (448)..(448): n is a, c, g, or t
tcagagcgtcgtctcacgaccggtgctcgatttagtgtgagtagtttgggtttggggatgagcaaaactgacaagtcaaggcaggaagatgttgcatcacaactcattgggtttctgctgctctgggttcngcctccgagggtgaaattgtgctgactcagtctccagtactttcagtctgtnactaccgaaaggagaaacgtcaccaatccaccgtcggccgggcctagtaccgagtgtacggttggtagtaacgtcttaacgacgttcggaacagcgaacgtacggccgtaggtaccgtagtacctacaaagtcctacctctaataccgtaagtacgtcgtaccgttccctacggttccctttacggtccggtaccggggtccctacgtacggtcgtaggtcgtcaggttgacgtcgtaggactactacgttccaccgtcaccgtntacagtacgcgtagacgtctagacgatgtctacaacgtacttatactgtactacgtactaacgtaacttaaccttactttaccgtaacgtaagttcgtacgtaccgtaccgttaaccgacgaaacgggtaccgtaacggtacgtaacgggaaacgttaaacgttaaagggtaactttcgggaccggtctaccggaccttaacggtacttaccggtcttccggttaacc

SEQ ID NO: 171549 - DNA, 781 bp, Homo sapiens
  misc_feature: GYAE6OF01BXYIP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccaggggtgaaattgtgctgactcagtctccagtactttcagtctgtgactaccgaaaggagaaagtccaccatccaccgtcgccggccagtcagagtcgttaggtagtagtacttacacgtcggtaccagcaagtaacgaccgaggtccagtctaccgaaagtcctcctacactacgtaagttactcgtccttacccgtacgttcccttccgtaccggtaccggggttcccccgtacggtacgggttccgtaagggtccggtacggtacgttcggtacgttcggtacgggtacctaacgttaaccgtttaccaccccctacctaacctaacgttaccaaacgttaccgtaccgtaggtaaaccgtacgttacggaaggtacgttacgtaccgttaacgtacctttaaaccgttttaacgtttacgttaacgttaccgttaacgtaccttaacgggtaaccttttaacccgttaaccttttaacccgtaaacgttacggtaacgttaccgttacccgtaaccccggttaccggaacccggtaaacggtaccgtaaccgtaccggtaaggtaaacgtaaaccgttaaacgtacggttacggtacggtacgcgtacctaacgtacttcgttcgttcccgttaccg

SEQ ID NO: 171550 - DNA, 768 bp, Homo sapiens
  misc_feature: GYAE6OF01EZXRB.27.78.H01.1.454.CMB.1.raw
  modified_base (195)..(195): a, c, t, g, unknown or other
  misc_feature (195)..(195): n is a, c, g, or t
  modified_base (245)..(245): a, c, t, g, unknown or other
  misc_feature (245)..(245): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccagggggtgaaattgtgctgactcagtctcagacttcagtctgtgactcaaagganaagtcaccatcaccgtgccgggcagcgagagtcgttggtagtagcttacnctggtaccagcagaacgccgaggtacgtacgtctaccaaaacgccttacctcatactaagtatcgtaccttcccgtacgtccttccgtcgtaccggggtccccttcggtacggttacgaggttcgggctacggtggtactcgtacggggtactaacgtactttacccgaccctaccaacctactactaaacgtacgtacccgtagggaacgtacgtagtaagacgttcgtaccgtacgtaacttaaccttttaacgttaacgttcgttaccgtaagttacgtaaacgttaaccgtttaaacctttaacccgttttaaccgttaaccgttaaaggttaccgttaacgtttaacccgtaaccccggtttaccgggaaacccggtaaaccgggaaaccgttaacccgggtaaagttaccgggtaaaacgttaaaaccggtttaaaacgtaacggttacgggtacccgtacgttaaccccgtacccgtaaccttaacctttccgttaccggtttaccctttaccccg

SEQ ID NO: 171551 - DNA, 979 bp, Homo sapiens
  misc_feature: GYAE6OF01ADKB8.27.78.H01.1.454.CMB.1.raw
tcagagcgtcgtctcacgaccggtgctcgatttagtgtgagtagtttgggtttggggatacttaaaagaggttctttctctgggatgtggcatgagacaaaactgacaagtcaaggcaggaagtattgttgcctaatcaacgaactctagtttgggtttctgctagctcgttcgggttaccacgtccctaccggaggggtagtaacttggtcgtctacgactcgtacgtcctaccgtaggttacctttcgtacgttcgttggtacaccgtaccgaaagggtaataaaccgtaccgtacctacttcccgaacccggtccgggaccggtaccgtaagtaccgtaggtacggttacggggtttaggttaacgttacgtacctaccggtaaccgttacggtacacggaacgaccggtaaccggtacgtacggtaccgtaacgttacccgtaaccgtaaccgtccctttacctactacgtaacgtaacgtaccgtttaccgtaccttttaccgaccgtttcccgttaccggttaccgggtaccccggttacccggttagggttaaccgtacggtacggtcggtacgtacggtacgggtacgtacgggttacaccgtttaacccttaccttaccccaaccccgttaccgtaaacccttaacgtaccggttaaaacggaccccggttaacggggttaccgggtaaagtccccggtaaagggtacgttacgggtaaccctttaaccgggtactttaaaccgttaacccgtttttacgtacgtccgtttaaacctcggtttaaaccggtacgttttaaaccccggtttaaccttttaccggttaaaaccgttacggtaacccgggttttaacccgtaacccgggtttacccccggttaaaccggtacccggggtaacccggttaaacgggacccgggttttaacaacgggggtttaaaacccgtaaacgtttaaaaccgggttacccg

SEQ ID NO: 171552 - DNA, 972 bp, Homo sapiens
  misc_feature: GYAE6OF01BYZ3J.27.78.H01.1.454.CMB.1.raw
  modified_base (148)..(148): a, c, t, g, unknown or other
  misc_feature (148)..(148): n is a, c, g, or t
  modified_base (934)..(934): a, c, t, g, unknown or other
  misc_feature (934)..(934): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtanaaattgtgctgactcagtctcagtactttcagttctgtcgactaccgaaaaggagaaactccaaccatccaccgtcggcccggggacctagtcgaaggtacggtcggtttagggtaagtacgtacctttaacgaccgttacggtaacccgaggacgaacggaaacggacccgaacgggtacctaacggttaccttaacccgaaaacggtccctttacccgttacctaacgttaaccgtaaaacggttacgttacccggtaaccccttttacccccgtaaccgggttttccccctttaccggttaccgggtaaccccggggggtttccccccgttacgggttaacgggtttacccggaagggtttccgggaacggttacgggttaacgggtacgttaccggggttaccggggtaaaacctttacccggttaaccgtttttaccccgaaccccccgtttacccaaacccgtaaacttaacccgtaaaaccgtttacccgggttaacccggtaacggggttaaccgtaaccgggtttaacgggaaacggttacgttaccgtaacggtttaaccggtaacctttaaacgttttaactttaaccggtttacgaaccgttacgttaccgtaaaggtttaaccgtttaacccttttaccgttttaaacccgtaacgttaaacggttacgttaacccgttacgttacccggttaacccggggtaaccggaaacgggtaccgtaaacggcgtaaggtaaacgttaaaaccgtacggtaaccggttggtaccggtntaccgggtactaacctagttcccttgttacccgttacc

SEQ ID NO: 171553 - DNA, 971 bp, Homo sapiens
  misc_feature: GYAE6OF01E47AR.27.78.H01.1.454.CMB.1.raw
tcagagcgtcgtctcacgaccggtgctcgatttagtgtgagtagtttgggtttgggggcatgagcaaaaactgacaagtcaaggcaggaagatggttgccatcacaactcagttgggtttctgctgctcgtgggttccagcctccgagggtagaattgcgtctcgactcgtacgtcctacacgtacttcgtagtctgtacgacctaacgaaaaggagaacgtccaaccgtactccgaccgtcgggcccggactacgtacggacggtacggtcggtttaggtacgtacgtacctttacgaggttaccggaacccgaggaaccgaacggtaacggtacctaacgggtacgtaccggttaccaaccgtaaccgtccttacctaacgtactacgttaacgtcgttaccgtcccgttaccccgttaccgttccgtttaccgtacccgggttacccgggttcccccgttacgggtacgttaccggtagggtcggtacgtaggttacggtacggttcggtacggtaccctacctttacccgtttacccaacccgttaccgaccttacgttaacgtaacgtccgggtaacccggtaacggtaacgttacgaacggtaacgtcggtaccgttcgttaccggttaaaccgtttaaccttttaaccgtttaaccttacccgttaaacgttaacccggtttaaacgttaacccgtttttaaccgttaacccgttttaacccgttaaccgttaacggttaccgtttaacccgttaaccccgggttaacggttaacccccgggtaacggggaaaacccgggttaccgtaaaaccccggggttaaacgtaaaccggggttaaaacgttttaaaaccccgggggttaaaccttaggggggtttaccccgttacggtacccggttaaccccgtaactttacccggttaccccttttaccgggtttaccctttccccggttttaacccg

SEQ ID NO: 171554 - DNA, 703 bp, Homo sapiens
  misc_feature: GYAE6OF01CGXIS.27.78.H01.1.454.CMB.1.raw
  modified_base (261)..(261): a, c, t, g, unknown or other
  misc_feature (261)..(261): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtcctccagtactttcagtctgtgactaccgaaaggagaaaagtcaaccactcaccgtcggccgggccagtcgagaggtcgttaggtagtagtcttacnctcggtaccagacgagaacgccaggtcagtcctaccgaaacgcctcctcactactaagtactcgtccttcccgtacgttcccttccgtaccggtaccggggttcccctggtacggttacgacggtggtacgtaggtggtacgtcggtagggacctactactttaccacccgtactaccctaatactaagtccgtacgtaggtaacgtacgtagaagtacgtcgtaccttacgtaccttaaactttacttaccgtacgttactacttacgaacgttaccgtttaaccttaacctttaaccgtactaacggttactaccttacccgtacccgttaccgggaaccgtaacgggtaccgtaaccggtacgtaacgggtaacgttaaccggtaaacgtcggtacgtccggtacgtacgtacctacgtactttcgtcgttccttaccg

SEQ ID NO: 171555 - DNA, 633 bp, Homo sapiens
  misc_feature: GYAE6OF01DL6GK.27.78.H01.1.454.CMB.1.raw
  modified_base (159)..(159): a, c, t, g, unknown or other
  misc_feature (159)..(159): n is a, c, g, or t
  modified_base (261)..(261): a, c, t, g, unknown or other
  misc_feature (261)..(261): n is a, c, g, or t
  modified_base (481)..(481): a, c, t, g, unknown or other
  misc_feature (481)..(481): n is a, c, g, or t
  modified_base (607)..(607): a, c, t, g, unknown or other
  misc_feature (607)..(607): n is a, c, g, or t
  modified_base (619)..(619): a, c, t, g, unknown or other
  misc_feature (619)..(619): n is a, c, g, or t
  modified_base (630)..(630): a, c, t, g, unknown or other
  misc_feature (630)..(630): n is a, c, g, or t
tcagagcgtcgtctcacgaccggtgctcgatttagtgtgagtagtttgggtttggggatgagcaaacgtgacaagtcaaggcaggaagatggttcgccatcaactaactcattgggtttctgctgctcgtgggttccagcctccgaggggtagaattgngctgactcagtctccagactttcagtctgtagactacaaaggagaaacgtcaccactcaccgtggccgggaccagtcagagtcgttaggtagtagacttacncgtggtaaccagcgaagaacgccgaaggtacacgtcctaaccaacgtctcctacatacgtaagttactcgtccttacccgtaacggtcctttacgtccgtacggggtcccctacgggtacggttccgaggttcggactacggtagggactcgggtacggacctacgtacgttcccaccctacaccgtataccactacgcgtacgaacgtcgtagaacgtnacgactacgacttaacttatactacgtcacggttacaacgtacttaccttacttacccgtagtagtctacctccgtacgttacggacgtaacggacaggacgtagaactaagtaacgagtcggtcncgtacgacgacncttactcgttntcc

SEQ ID NO: 171556 - DNA, 685 bp, Homo sapiens
  misc_feature: GYAE6OF01DR8NY.27.78.H01.1.454.CMB.1.raw
  modified_base (664)..(664): a, c, t, g, unknown or other
  misc_feature (664)..(664): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgacctacgaaaggagaaagtcaccatcacctggccgggcagtcgagagtcgttaggtagtagtcttacgacgttcggaaccaggcaagaacgccaggtccagtcctaccaaagcctacctctataccgtaagttactcgtaccttcccgtaacgttccctttcgtccggtaccggggttccccctaggtacgggttacgcggttcggaccgtaggtacggtacgttcgtacgggtaactaacgtactttcccaaccccgtcaaccctataccgaaagtacgaccgtaaggaacgtgttaagaacgtagtcgcttagaaccttaacgtttactacttcgtactataccgtaagtaactttaaccgtttacttaaccctgtaaagttcgtacttcccgtaccgttaccggacgaacggtacctacggacgtaggaaacgtaacgttaaacgtacgttggtacggtactcgtacctaacccnttaccgttcgtcgttaacccg

SEQ ID NO: 171557 - DNA, 666 bp, Homo sapiens
  misc_feature: GYAE6OF01BP0VK.27.78.H01.1.454.CMB.1.raw
  modified_base (181)..(181): a, c, t, g, unknown or other
  misc_feature (181)..(181): n is a, c, g, or t
  modified_base (232)..(232): a, c, t, g, unknown or other
  misc_feature (232)..(232): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctcgtgggttccagcctccaggggtnaaattgtgctgactcagtctccagtacttcagtctgtgactacgaaagganaacgtcacatcacctcggccggcagtcaggacgtcggttaggtagtacgtcttacacgtcgtacngtacagaacgcagtcntcacaagctaccnatcaagtcncgtcctaccncgttccttcgcggtaccgggtccctacggtaggttccaggttcgcgtaggtcggtacttccggtgggtaacctaccgttacttccccgtaacccctacgaacgttacctaacgtaaacgtaaccggtcccgtaaagggaaccttcgtaagaacggttgtaccggtacgttacgaacctttaacgttacttactgtactaactacgaacgtacgtttaacttcccgttaaccagtaacgtctaaccgttacccgttaaccttacccgggaaccgtaaacgggtacctacggtaagtacggtaaagtaaacgttaaacccggg

SEQ ID NO: 171558 - DNA, 716 bp, Homo sapiens
  misc_feature: GYAE6OF01BFY9C.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaacgtcaccatcacctgcccgggcagtcgagagcggttggtagtagtccttacacgtacgggtaccacgacgaaggaacgccgaaggtccacgtcctaccaaacggtcctacctacgtaactacgtaacggttactccgtaccttacccgttacgttcccgtttacgtccggtaccggggttcccctcggttacggttaccgtaggtcgggccgtaggttcgggacgttacggtacgggtaacctacgttaccttaccctacccctacctacctactacaacgtacgaccgtaggacgtcgtaagaacgtagtctacgacgtaaccttaattacgtactcgtacactacgtattacgttaacctttaccgttaactacgtacggtacgttaaccttcccgtaaccggttcggaacccggaacgggtacccgaggtacggtaaggtaacgttaaacgttaaacggtacgttcggtaacggtctaccggactacgttaactcgtttcgttccttaccg

SEQ ID NO: 171559 - DNA, 809 bp, Homo sapiens
  misc_feature: GYAE6OF01E2OXZ.27.78.H01.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
tcagagcgtcgtctcacgaccggtgctcgatttagtgtgagtagtttgggtttggggatcttaaaagaggtttctttctctgggatgtggcatgagacaaaactgacaagtcaaggcaggaagatgttgccatccacaactctagtttgggtttctgctgctcgttgggtccagccctcgaggggtataattgngctagactcacgtcctaccgtattaccttttcgnttccgtagtacgaaccttaaccggaaagggaacgttaaacnccaacccacgttacccaccgggtccgggcccgggtaccctaggtaccgtaaggacggttaccggttttaggtaacgtaccgtacctttaaccgaccgtttacgggaaccaggaccgtaacggacgtccgtacgtacgtacgtacccaacaacgtcctacctacaacttaccgtaaagtctacttcccgttaactttcccgttccgttaccgtacccgggttccccgggttaccgtaccgggtagttacggtcgggtagtccgttaggagttacgcgtacgggtacctacgttaccttccccaacccttaccactaactacgtaacgacgttaccgaaggtacgtaccgtaagacttacgcgtaccgtactttaacggtaactttacgtacgtacgttaaccacgttaagtaacctttaacgtttaccttaacccgttaccgtgttaaaccgtccttaacctacccggttaacggtaaccccggaaggaaaccgtacccctaaacgggtaagttaacggtaaacgttaacgttaaacccgg

SEQ ID NO: 171560 - DNA, 728 bp, Homo sapiens
  misc_feature: GYAE6OF01BD3U5.27.78.H01.1.454.CMB.1.raw
  modified_base (184)..(184): a, c, t, g, unknown or other
  misc_feature (184)..(184): n is a, c, g, or t
  modified_base (309)..(309): a, c, t, g, unknown or other
  misc_feature (309)..(309): n is a, c, g, or t
  modified_base (486)..(486): a, c, t, g, unknown or other
  misc_feature (486)..(486): n is a, c, g, or t
  modified_base (574)..(574): a, c, t, g, unknown or other
  misc_feature (574)..(574): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagattgttagccatcacaactcagttgggtttctgctgctcgtgggttccagccgtacgagggtnaaagtttgagctagaccttcagtcctcagtactttcagtctgtgtactaccgaaagggacaaagtccaaccgatcgaccgtcggccggacagtcaggtaggtcgttaggtagttacgtcttaacncgttacggaaccaggaccaaagaccggaccgtagggtacctacgttacccgtaacaaaacggttccctacctaacctactaaccggtaaagttacgttacgtcccctttacccgacgtttccctttaccggttcccggaaccgggttcccctacggtacggttccggagttccgggngtacgggtacgcttcggacgggtaaccttacgtccgtttacccacccttacgaccctagtactaactcgtacgtacgagtcctaaggngtactcgtagtcttaactaactttacgtacccttgtacctacgtagtaaccggtaactttacccgttaacttcctaacggtaagttcgacgttaccctccggttaacgccgtaaacgggtcaacggtaccgtaaagacgttaaaccgtaaacgg

SEQ ID NO: 171561 - DNA, 856 bp, Homo sapiens
  misc_feature: GYAE6OF01BE7PY.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgtctcgtcggttccacgcctccgaggggtagtaaagttgtgctgacctcgagtcctcctagtacctttcagtctgtnaccgtaccgaaaggaacgaacgtccaccactaccaccgtcgacccggaccagtcgaaggtcggtcggttaggtacgtacgtaccttaacgtacgtacggtaccgtaagacgaagaaccggtaccgtaaggtccgacgttaccaacgaacgtcctaccgtacacttacgtaacgttactccgtaccccttcccgttaccgttacccgttccggtacccgggtacccggtttaccccgtacgggtacggttacgtaacgggtcggtacggttacggtaagtccggttacgggtacccggtaactttacccgttaacgtttcccccgaaccctacctaacctacgttaaacctaaccggtacgaaccggtaagtaccggttacaagggtaactacgtaccggttccttaacgtaaaccgttaactttcgttaacgttacggttaaacctacgtaacccgttaacggtttaaccgttaaccgtttaaacctttacgaagtttaccgaccgtttaccgtaaccccgtttaacgggacccgtaaccgggaaggttaacccgaacgggttacgtaaacgggttaacgttaaaacgtaccggttaccggtggttacctcggaaccgtacccgttacttaaccggtttctacccggttcttaaccccg

SEQ ID NO: 171562 - DNA, 759 bp, Homo sapiens
  misc_feature: GYAE6OF01B7R71.27.78.H01.1.454.CMB.1.raw
  modified_base (576)..(576): a, c, t, g, unknown or other
  misc_feature (576)..(576): n is a, c, g, or t
  modified_base (702)..(702): a, c, t, g, unknown or other
  misc_feature (702)..(702): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtcgggttccagcctccgaggggtagtaaattgtgctgactcagtctccacgtactttcagtctgtgactacgaaaggacgaagtccaccactccaccgtcggcccggccgagtaccgaggacggtcggttacggtagtacgtccttaacgacgtcggtaaccgagacgaaggaacgccgacggtacacgtacctaccgaaacgtcctacctacactacgtaacgttactccgtacccttacccgtccgttacccgttccgtacccggtacccgggttaccccgttaccgggtacggttccgaggttacggccgtaggtacggactccgggtaggtaacctacttacttacccgtaccctacgaaccctactacctaaagtccgacggtaacggtacgtacgtaagggaactcgtacgtactacctactttaaactttacttacgtcgttanacgtaacgtaagttaccgtttacctttaaacgttccgtaagtacgttacgtaaccgttaccgttaacccgacggtaacgaaccgggtaaccacggtacgtaaacggaaacgtaaccgtttaaacgnggtccgtcggtaacccgtacgaccgttacgtaacgttcgtttaccgtcccgttaacg

SEQ ID NO: 171563 - DNA, 938 bp, Homo sapiens
  misc_feature: GYAE6OF01C7K56.27.78.H01.1.454.CMB.1.raw
  modified_base (185)..(185): a, c, t, g, unknown or other
  misc_feature (185)..(185): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactctagttgggtttctgctcgcttcgtgggttccagcctcgaggggtanaattgtgctgactcagtctacagtacttcagtcgtagtgacctaccgaaaaggacgtaacgtaccaacctatcctaaccgtcggccccggtaccgaaggttaccgaaggtacggttaccggtagggttacgtagtaccttaacgacgttacggtaacgaggacgaagtaacggacctaggtactacggtaccttaaccgaaacgtccttacctaactaacgtacgtaaacggttaacgttccgggtaccctttacccgtactttaccccggtttacgtacccggggttacccggggttccccggttaacggtaacgggttacgaacggggttcggacggtacggtttagggtacgtccggttaacgggaacctaaccgttaacctttaaccccacccgttaacccgtaacttacgaaaccttaaacggtaccggtacccgggttaaaggtaaccgtacgtaaaccgtaaggttaacttacccgtcggtttaaacgtacccggtttaaaacttttacggttttaaacccgtacggtttaaacccaacggttaaccgtttaaggggtttaaaccctttaaaccccgggttttttaaccgtaaaacccgtaacggtaacggtttaaaccgaacccgtttacccgggtaaaaccccggtttcccgggggaaaaacccgttaaaccggggtaacccttaaacccgggggttaaataaacccgggggttaaacgttaaaacgggtttaaaaaccccggg

SEQ ID NO: 171564 - DNA, 795 bp, Homo sapiens
  misc_feature: GYAE6OF01EPELI.27.78.H01.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
tcagagcgtcgtctcacgaccggtgctcgatttagtgtgagtagtttgggttggggatgagacaaaactgacaagtcaaggcaggaagatgttgccatcacactcattggttctgctgctcgtggttccacgcctcgaggggtanaattgngctgactctagtcctactagtactttcgacgttctgtcgaactaccgaaaaggaacgtaaacgtaccaacctacgtccgaccggtcggaccggtccgaagtccgaggtacgtcggttaggtatacgtccttacgacgttacggacctaagcgaacggaacgtcccgtaaggttccacgttacctaaaccgtaacgtcccttaccgtacgtaactacggaaacggttccttacgtccccgttaccgttacgtcccggtttcggaacccgggtccgggttccccgtagggttaacggttcggaacggttcgtacggtagttacggtcgtacggtacggtaaacctacttaccttacccgactaacccgtacttaagaactaacggtcacggtaggtacgtacgtaggtacgtacgtctacgacgttttttaacaactttctacgtactacgtaacgttacgtaacgttaacgttaccttaacgttaaccgtaacgtaacgtaacgtaccgttacccgtacggtaacccggtaccggtaacgtaaccgaacggtaacggtaacggtaaacggtaacgttaacgtaacgttccggtaccgtacgtacccgtaccttacttaacgtttccgttaccgttccgttacccg

SEQ ID NO: 171565 - DNA, 840 bp, Homo sapiens
  misc_feature: GYAE6OF01DMVX8.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcatttgggtttctgctgcttcgtgggttccagcccgtccgaggggtagtaagttgtgctgactcgacgtcctacacgtactttcgagttctgtacgaccgtaccgaaaaggaacgtaaacgtccaacctacgtaccgtaccggtcggccgggaccacggtaccgaggtacggtcggttaggttaacgtacgttaccttactacgtacggtaccagcgaacgaacgccgtaggtacctacgtaccaaccgaacgtcctacctacactactaagtactcgtccttacctcgtttcctcgtaccggtccgggttaccctggtacggtcgaggtcggcgtaggttcgtacgtaccggtacggtaaccttaccgttaccgtttaccccaacccgtaccgtaactacgtaactaaaccgttcggtaacccggtagggtaaacgttaccgtaggtaaaccgtcgtcggttaacctacggttaaaccctttaaacgtttaaccgttttacgtaccgtttaaccgtaagttaacccggttacgtttaaccgttaaaccccgtttttaacgtaaccccgtttaagtaaaccggtttaccgtacccggttaccccggttaaacccggtttacccggggaaacccgaaacgggttacccgtaaaccgggttaggtttaaaaccggtcggtttaaaacccgtttaaaaccgggg

SEQ ID NO: 171566 - DNA, 723 bp, Homo sapiens
  misc_feature: GYAE6OF01E4BZX.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccacgcctccgaggggtagaaattgtgctgactcagtctccagtactttcagtctgtgactacgaaaggagaagtcacatcaccgtcgccggccagtcgagagtcgttggtagtagtctacacgtcgtaccagacgagaacgaccgagtcacgtacctaccaaacggcccttacctcgaactacgtaacgttacgttacgtcctttaccccgtacgttccctttaccgtccggtacccggggttaccccgtaccgggtacggttccgaggtcgggacgtaaggtggacgttacggtacggggtaactaccgttactttacccgaccccttaccgaaccctaacttaacctaaacgtaccgtaccggtaacgggtaacgtacgtaaggaaacgtagttacggacttacgtaaccttaacgtttaacttacttcggtactactacgtaacgtaaacgttaacctttacctttaaccgtacgtaagtacgtaaccttccgtaccgttaccggacgtaacggactaaccgacgtagggtaacgtaacgtaaacggtagtagtcggacgtacacaccttcgtacgttcgttaccg

SEQ ID NO: 171567 - DNA, 803 bp, Homo sapiens
  misc_feature: GYAE6OF01D1M6T.27.78.H01.1.454.CMB.1.raw
  modified_base (153)..(153): a, c, t, g, unknown or other
  misc_feature (153)..(153): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagagcgtcgtctcacgaccggtgctcgatttagtgtgagtagtttgggtttgggggcatgagcaaactgacaagtcaaggcaggaagatgtgccatcacactcatttggtttctgctgctcgttgggttccacgtccgtccgaggggttanaaagtttcgtgctacgactcgagttcctaccagtaccttcgagttcctgtcgactacgaaagganaacgtccactcncgacgtcggcggcagtcagtcgtcggttaggtagtcgtacttacagtaccggtacgacgacaaggtaaccgacgtacggtacgacgttaccgaaccgtaactcccttaccgtactaactcgtaagttctaccgtcccgttacccgtaccgtttcccgttaccgtaccgggttaccgggttcccccgtacggtacgttcgtacggttccggacgtacgggtacgtacggttcgtacgggtaccttaaccgtacttacccgaccctacctaacctacgttaactaacgttaccgtaccgttaacggtaacgtaccggtaagtacggttactacgttacgtaaccggtaacctttaacgttttaacgttaccgttacgtacgttaaccgttaacttaacggttaaccgtttaaccttaaccgtttaaccgttaaggtaccgtattaaccgtcccggtaacccgtaccggaccgttaacgggaactacgggttaacgtacgtaaacggttaaacgtaacggtaaccgttcggtaacggtcgttaaccggacttccgtaccgttccgttccttacccg

SEQ ID NO: 171568 - DNA, 789 bp, Homo sapiens
  misc_feature: GYAE6OF01C9F0Q.27.78.H01.1.454.CMB.1.raw
  modified_base (123)..(123): a, c, t, g, unknown or other
  misc_feature (123)..(123): n is a, c, g, or t
tcagagcgtcgtctcacgaccggtgctcgatttagtgtgagtagtttgggtttggggatcttaaaagaggttctttctctgggatgtggcatgagacaaaacctgacaagtcaaggcaggaanatgttgccatcacaactcattgggttctgctgctctgggttccagcctccgaggggtgaaattgtgcgtgactcacgtctaccagtacctttcgagtctgtcgacctaccgaaaggaagaacgtccaaccattccaccgtcggccgggacctagtacaggagtcggttaggtagtacggtactactacgtcggtaccagtcagaacgccgaggtactacgtctacaacgcttacctacatactagtactcgtccttacctaggttcccttacgtaccggtaccgggttcccctacggtacggtttacaggggttaccgacgtacggtcggttacgtaccgggtacgggtaacctaacccgttaccttttaccccgaacccttaccgtaacctaattaaccggaaacttaccggtaccgtaggtaaaccgtacctaaggtaacgttacgtactccgttacggtaacccttaacttttaacggttaccttaggtacccttaattacggaacgtttaacggtttaaccccttttaaacttccctaacggttaaccgtacgggttaaccccttacccggttaacccgttcccgggtaaaccgggttaaccgggtaaacccgtaacggttacccggtaaaaggtaaccgttaaaacgggtttaaaacccgg

SEQ ID NO: 171569 - DNA, 717 bp, Homo sapiens
  misc_feature: GYAE6OF01CUUKN.27.78.H01.1.454.CMB.1.raw
  modified_base (97)..(97): a, c, t, g, unknown or other
  misc_feature (97)..(97): n is a, c, g, or t
  modified_base (704)..(704): a, c, t, g, unknown or other
  misc_feature (704)..(704): n is a, c, g, or t
  modified_base (712)..(712): a, c, t, g, unknown or other
  misc_feature (712)..(712): n is a, c, g, or t
tcagagcgtcgtctcacgaccggtgctcgatttagtgtgagtagtttggggtttgggggcatgagcaaaactgacaagtcaaggcaggaagatgttnccatcacaactctagtttgggtttctgctgcgtcgttgggttcccacgcccgtacggtaggggtagtaaatttgtgctagacttcacgtcctactacgttactttcagttcgtgtacgtaccgtaaccgaaaggaagtaagtccactaacgtccaccgtccggcccgggacacgtacgacggtaggttacggttaggttacgtacgtacgtaccgtacgtacggtaccagacgaggacgcgtacggtctaacgtcctaacgaactcctctacatacgacgttactcgttaccctccgtacgtccttccgtacggtaccggtcctagtacggtacgtggtacggatacgggtgtactcggacgtaacctccgtttaccttacccgaccctacgtaactaccgtaactacgtccgtaacggtacggacgttaacgaaggtaacgtacggtacctacgttaacctacgtttaacttacgtttaccgacgtaatacttacgttaacttacctttaacgttttaccacgtacttaacggcttacgtaccgtcgtacgggactaaggactacggagtaacgtattaacgtacgtgtcggtatacgcacttatnttccgttntaccg

SEQ ID NO: 171570 - DNA, 727 bp, Homo sapiens
  misc_feature: GYAE6OF01AX1BL.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgaggggtgaaattgtgctgactcagtctccagtactttcagtctgtgactaccgaaaggagaaagtcaccatcacctggccgggccagtcagagtcgttggtagtagtccttacacgtaggtaccagacaaggaacgccgaggtcacgtcctaccaagcctacctacactacgaagttactcgtcccttaccctacgttcccttccgtaccggtaccggggttcccccttacggtacgggttacgtaggttcggacgtaggttacggacgtcggtacgggacctacgtacctttacccgaccctaccaaccgtataaccgtactaacgtccggtaggaaacgtcgtaaggaaagtcgtcgtacggtactaaccgtaacgtttacgttacgttcgtactacgttaacgtaacgttaacctttaacgtttaaccctttaaccgtacgttaagttaccgttacgttacccgttaacccggttaccggaaccggtaaccgggtaacctacgtacggtaggtaactaaacggttaaaccgtacggtaggttccggacgtaccgtaccaaacttccgttcgttcgttacccg

SEQ ID NO: 171571 - DNA, 871 bp, Homo sapiens
  misc_feature: GYAE6OF01E2XXR.27.78.H01.1.454.CMB.1.raw
  modified_base (118)..(118): a, c, t, g, unknown or other
  misc_feature (118)..(118): n is a, c, g, or t
  modified_base (154)..(154): a, c, t, g, unknown or other
  misc_feature (154)..(154): n is a, c, g, or t
tcagagcgtcgtctcacgaccggtgctcgatttagtgtgagtagtttgggtttgggggcatgagcaaactgacaagtcaaggcaggaagatgttgccatcacaactcattgggtttcngctgctctgggttccagcctccgagggtgaaattgngctgactcacgtctaccagtactttcagtctgtacgacctaccgaaaaggaacgaaaacgtccaacctacgtacccgaccgttccgggccccgggacctaaggtccgaaggtaacggtccgggttttaggtacgtacgtacctttaaccacgttacggtaaccacgacgaacggaaccgtccgtaggtcctacggtcctaacctaaacgtccccttactacctacgttaacctaaagttcgtaccgtaccctttccccgtaaccgtttcccgtttaccgttacccggtacccggggttacccccgtacggttacggtttaccggacggtcgggtaccgtacgggttgggtacttacggtacgggtaaccctaccgtttaaccttcccctaaaccccgtaccttaaacccgtaacttaccgtaaacgtccgttacggaacgggtaacgtccgtaacgggaacttacgtaccgaccgttataacccgttactttaacgtttaccgtcgtacgtaaccgtactaacgggttaaccttaacgtttaaccctttaaccgttatacggtttacgacctttacccgtaccgtaccggaacccgtaaacggaccgtaacgtaacccgggttagtaaacgtttaacccgtaaaccgggttagttaaccgggttaccggacgttaacccgtacccgttaacctcccggtttaattcccggtttaccg

SEQ ID NO: 171572 - DNA, 803 bp, Homo sapiens
  misc_feature: GYAE6OF01A843P.27.78.H01.1.454.CMB.1.raw
  modified_base (574)..(574): a, c, t, g, unknown or other
  misc_feature (574)..(574): n is a, c, g, or t
  modified_base (672)..(672): a, c, t, g, unknown or other
  misc_feature (672)..(672): n is a, c, g, or t
tcagagcgtcgtctcacgaccggtgctcgatttagtgtgagtagtttgggtttggggagtgagacaaaactgacaagtcaaggcaggaagatgttgccatcaacaactcagtttgggtttctgctgctcgtcgggttccacgcccgtccggaagggggttgtaaaagttgtggctcgacctcacgtctacctagtactttacgagttcgttcgtagaaccgtacggaaaaggtaaacgtaaacggtccaaccgaactccgtaccgtaccggcccggtaccgtacggtccgtaaggacggtcggttaggtaacgtacgtaccgttaacaccgttggaaccgaacggacgtaacggaacggacctacggggtacacgtttacccggtaaccaacgtcctacccgtacgtacaacggtaattacggttccgtccgttaccctaccgttccgtttccgtaaccgggtcccgggttcccgttaccggacgggttagacggtcgggtatacgggtcgtagtcggtacggtactacctttaccacccggtaaccctcgtaaacgtactaacgtcggtaccncggtaacgacggtactaacggtaacgtcggtactacgtaacgttccgtaaactttcgtactagtcctaacgtagtacgtttaacgtacgttaaccgtntaacgtaacgtacttacccgacgtttacccgggaacggactaaacgggcctaacgtcgtaagtaaaccggtaacgtaacgaggttcgacggtcgtcccgtaactacggttactacttccggtcttaaccgg

SEQ ID NO: 171573 - DNA, 826 bp, Homo sapiens
  misc_feature: GYAE6OF01ACY4W.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtgaaattgtgctgactcagtctccagtactttcagtctgtgactaccgaaaggagaaagtccaccactccacctggccggccagtcgagagtcggttggtagtacgtcttacactcggtaccagcagaacgccaggtcagtacctaccaaagcctcctacatactaagttactcgtccctttacctacgtttcccttccgtccggtacccggggtccccctacggtacggttcgagggtcggacgtaggtacgtacgtcggtcggtaactacctacgtttaccctaaccccgtacaaccctacgtactaaacgttacgtaccgttagggaacgtacgttaaggaacggtacgttacggtacctacggtaccctttaaaccgttttacgttaacgttacgtaccgtaagtaccgtaacggtttaacctttacccgttttaaacccgttttaacccgtaacgttaacggtttaccggtaaccgttacccccgttaacccggttaaccccggggaaccgtaaacccggggtaaccgaacccgggttaaaccggttaaacgggttaaaccgtttaaaaccggtaaaaccgggttaacgggttccgggtaaccggttaccgttaacggtaacccccttaacccttacggttttccccgttttaccggttacccttttaacccccg

SEQ ID NO: 171574 - DNA, 699 bp, Homo sapiens
  misc_feature: GYAE6OF01A4TO8.27.78.H01.1.454.CMB.1.raw
tcagagcgtcgtctcacgaccggtgctcgatttagtgtgagtagtttgggtttggggatcttaaaagaggttctttctctgggatgtggcatgagacaaaaactgacaagtcaagggcagggaagatgttgccatcacaactcagttgggtttctgctgctcgtgggttccagcctcgaggggtagtaaattgtgctgactcagtcctccaacgtacttcagtctgtagacctaacaaagggagaaacgtccaaccactaccgaccgtcggccgggacctagtacgagaggtcggttaggtagtagtaccttacactacggaccagacaagacgcgacggtcacgtacctaccgaaacgcctacctactaactacgtaagtactccgtccttaccgtacttccttcgtcgtaccgggtccctaggtacggtacgcgtcggacgtaggtacgtcgtacggcggacctaacttccgttccacctaccaactaactactaagtacgaccggtagtaacgtacgtaggaatgtacgtacgtactaaccttaagttaccgtatcgtaactagtaaccgaacgttaacgttaaccttaaccgttaaccgtagtacgttacgtacccttaacccggttcccgggtaacccgaaccgggtaaccggtaacacggtaaggtaacgttaaaggtaaaccgttaaacggg

SEQ ID NO: 171575 - DNA, 821 bp, Homo sapiens
  misc_feature: GYAE6OF01EXPOU.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtagaaattgtgctgactcagtcctccagtactttcagtctgtcgactaccgaaaggagaaagtccaccatcaccgtggccggcagtcgagagtcggttggtaagtagtcgttactagtacggtaccagacagaacgcgaggtctacgtactacccaagtcctacctactactacgtaagtacgtctacccttaccgtaccgttacccgtttcgtaccggtacccgggttaccccgttcggtacggttacgtaaggtcggtacgtaggttacggtacttccggtacgggtaacctacgttaccgtttacccaccccgttactaaccctactaaccgtaaacgtaccggtacgtacgggtaacggtaccgtaaggtaaccgtagtaccggcgttaaccgtaaccttaaacttttaccggtttaactaccggtttaacctaaggttaccggtaaagtttaacccgttttaaaccctttaacccgtttttaaacccgtaacgtttaaacggttaaacccgttaaccggttaccccgttaaaccccggttttaccggggaaaccccggtaaaacggggtaaaccccgtaacggggttaaaccggttaacgggtaaaaccggtttaaaaacccggtttaaaaacccggg

SEQ ID NO: 171576 - DNA, 913 bp, Homo sapiens
  misc_feature: GYAE6OF01A93UR.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcacaactctattgggtttctgctgctcgtggtccacgcctcgagggtagaaattgtgctgactcgacgtctaccgtacgtacttcgtacgttgtcgtacgaaccgtacgaaagggaacgtaacgtaccactacgtccgtaccggtccggaccgggtacctaggtaaccgaggtacggttacggttacgggttagtaacgttacccttaacggtaccgttacgggaaccaggaccgaagggaaccgaccggtaacggtaccgtaccgttacccgtaaccgaacggtacccttacctacgttaaactacggtaaagtacccgttccgttaccccttacccgttacgtttaccccgttccgggttacccggtacccgggggttacccgtccgggttacggtacggtaaccgggtgtaaccgggtaaggtcggtaaactcgggtacggaacctttaccgttaccgtaccctaacccgtctaacccggtaactacgtaaccgtcggtaacgtacgggtaccgtaaggtaacggtactaccggttacgtaccgggttaactttaacccgttaacttaccgtttacggacgtttaccgaactttaaccgaacggtttaactttacccgtttaaacgttaccgtaacgttaccggtaaccgttccgttaaccccggttaacgggtaacccggtaaacggtaacccggtataccgggaaaccgttaaggttaaacccggaaacttttacgggaagttcgggaccgttacgtaccccgtaaagtcccttttaacctacgggtttcctaaacccggtttacccgg

SEQ ID NO: 171577 - DNA, 694 bp, Homo sapiens
  misc_feature: GYAE6OF01A0LXC.27.78.H01.1.454.CMB.1.raw
  modified_base (217)..(217): a, c, t, g, unknown or other
  misc_feature (217)..(217): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaacgtccacactaccnccgtcggccggcacgtcagtgtcggttaggtagtacgtcttacactcggtaccagacaggaacgccgtaggtctacgtacctaccgaaacgtcctaccctactactacgtaacgttactctccgttacccctaagttcccttccgtaccgggtaccggggttccccctagggtacggttcgtacgggtcggacgtacggtgtacgttcgcgggtaacctacctttacgtttaccccaccccttaccaacctactaacgtacgtacgtaccgtaggaacgtcgtaagaacgtagtcgtactacggaacttaaacgtttacgttaacttcgtaacctattacgtaacgttacttaacccttacgtttaacctacgtaacgtcgtacctaccgtacgttacccggacgtaacggacgacggtacgtagtaacgtaacgtaacgtactggacctcgtacgtctactatcttcgtccttccg

SEQ ID NO: 171578 - DNA, 694 bp, Homo sapiens
  misc_feature: GYAE6OF01C1JEL.27.78.H01.1.454.CMB.1.raw
tcagagcgtcgtctcacgaccggtgctcgatttagtgtgagtagtttgggttgggggcatgagcaaaactgacaagtcaaggcaggaagatgttgccatcacaactcattgggttctgctgctcgtgggttccagcccgtccgaggggtgtaattgtcgctgactgacgtcctcagtactttcagtctgtagactaccgaaaggagaacgtccacctatccaccgtcggcccgggaccagtacgaggtacgtcggttaggtagtacgtacttacgcgtacggtaaccaggacgaaggacgaccgtaggtctaacgtccgtaaccgaaacgtccctacctactacgtaaccgtaagtacctccgtcccttacccgttacgttcctttcccgtaccggttacccgggttccccgtaggtacggttcgagtcggtacgtaggtcggtacgtcggtacgactacgtccttacccacctacactactactagtccgacggtagacgtacgtagaaagtcgtacgtctaacgtacttaacgttactacgtactacgtactacgtaacgtaccgtttaactttaactaccggtaattacgtcgtacttcccggtaacgtcggaaccggtacgaaccgtcgggtaagagtaaacgtaagtacgtagcgggtacacgtacccgactacttctccgttcgtacc

SEQ ID NO: 171579 - DNA, 798 bp, Homo sapiens
  misc_feature: GYAE6OF01BIEQN.27.78.H01.1.454.CMB.1.raw
tcagagcgtcgtctcacgaccggtgctcgatttagtgtgagtagtttgggtttgggatcttaaaagaggttctttctctgggatgtggcatgagcaaaaactgacaagtcaaggcaaggaagattgttgccatacaacaactctagttgggtttctggctgcttcgtcgggttccacgtcctccgaggggtataaattcgtgctgtactctacgtcctacgagttactttctagttctgtacgactaaccgaaaaggaagtaaacgtaccaacctactcaccgtcggaccggcgtacgtcgaaggtacgtcggttaggtaacgtacgtaccttaacgaccgttacggtaaccgacgacgaacggtaacgaccggtaacgtacgtaccgtacctaacccgaaacgtccttaccacttacgtaacgtaacgtcttaccgtacccgttaccttaccgttccttaccggtccggtacccgggttcccgttacgggtacgttcgaacggtcgtacgtaggtcgtacgtacgttacggtaacgtacctttacgtcccacctacctaaccgtactaactaaccgtaccggtacggtacgggtactaaccggtgtaacgtgtaaccgttacgtaccttaaacgtttacctttagttacctaacgttcctaaacgacgtttaaccggtaaccttttaacctaacgtttacccgaaagttcggttacgttaaccctacccggttcccgaagggaacccggaaacgacgggtaactaaccggtaagtaaacggttaaaccctaaacggg

SEQ ID NO: 171580 - DNA, 700 bp, Homo sapiens
  misc_feature: GYAE6OF01A4Z5S.27.78.H01.1.454.CMB.1.raw
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactctagttggttctgctgctctggtccagcctcgaggggtataattgtgctgactcagtcctcagtactttcagtctgtnacctaccgaaaggagtaactccaccatccaccgtcggcccgggcagtacagacgtcggttagtagtcgtacttacnctaggtaccagacaagaacgcgaggtcacgtacctaccaacgtcctaccgtacaacgttacgaagttactccgtcccttcccgtacgttcccttccggtaccggtcccggggttacccctaggtacggttcgtacgggtcggtacggtaggtacggtacgttaccggtacgggtaccctaactttacccgtttacccgaacccctaccctaacccgtataaccgtaacgtaccggtacgtacggaactccggtaagaaccgtacgttcgaccgttacgtaaccttaactttcgttacgtactacgtatacggtaacgttaccttacctttaaccttaccgtagtacgtcgtacttaccgtcccgttacggaacgtacggacctaggactaaggtagtaaacgtaacg

SEQ ID NO: 171581 - DNA, 767 bp, Homo sapiens
  misc_feature: GYAE6OF01B1WA5.27.78.H01.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (735)..(735): a, c, t, g, unknown or other
  misc_feature (735)..(735): n is a, c, g, or t
tcagagcgtcgtctcacgaccggtgctcgatttagtgtgagtagtttgggtttgggatgagcaaaactgacaagtcaaggcaggaagatgtgccatcacaactcattgggtttctgcttgctctcgggttccagcctccgaggggttgaaattgtgctacgactcagtctccagtactttcagttctgtnactacaagganaagtcaccatcactcggccggccagtcagnggtcgttacggtagtacgtctacgtacgtcggtacagcaagtacgccgaggtctacgtacctacgaaacgtcctacctacgtactacgtaagtacgtccgtcccttaccgtacgttccctttacgccggtaccggggtcccctcggtacggttacgtaggtcggactaggtggtactacggcggtacctaccgttacttccaccctcctaccctaagtacgtaactacgaccgtacggtaactacggagtacgacttagaccgttacgtaactaaccgtttaacgtttctagtaaccctagtaaccggaagtttaacggttaaccttttaccgtttaacccgttaactaaggttaccgtacttacccggttaaccccggttacgtaacccgggaaaccggttaaccggtaaaccgtgggtaaaccggtaaaacgtttaaccgttaaaacccgggtacccgttacggaaccggttacgggtaacccttaccctacccgtttaaanccccggttttaaacgtttcctttaacccccgg

SEQ ID NO: 171582 - DNA, 702 bp, Homo sapiens
  misc_feature: GYAE6OF01B3A02.27.78.H01.1.454.CMB.1.raw
  modified_base (138)..(138): a, c, t, g, unknown or other
  misc_feature (138)..(138): n is a, c, g, or t
  modified_base (510)..(510): a, c, t, g, unknown or other
  misc_feature (510)..(510): n is a, c, g, or t
  modified_base (689)..(689): a, c, t, g, unknown or other
  misc_feature (689)..(689): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccngcctcgaggggtgaaattgtgctgactcagtctccagtactttcagtctgtgactaccgaaaaggagaacgtccaaccatccaccgtcggccgggccagtcgaggaggtcggttagggtagtacgtaccttacacgttcggtaccagacaacggaacgccgaggtctacgtcctaaccaaacgccctcctactactacctaagttactccgtacctttccccgtacggtttcccttccggtccgtacccgggggttcccccttacgggtacggttcgacggtcgggcgtacggtcggtacgtcggtacgggacctacttaccgtttacccaccctccaacctaactacgaactaccgaccgtacgggtaacncggtaagagttacgacggtcctagtaccgtaacttttacgttacgtcgttacactagttaacgtacgtttaccttacctttaccgtacgtaacttcggacttacccgtaccgtacggtacccgaacggactacgacggtacgaagttaactaaggtcgtacgtgtaccgactacacgtnttccgtgttaccg

SEQ ID NO: 171583 - DNA, 783 bp, Homo sapiens
  misc_feature: GYAE6OF01BKZ5X.27.78.H01.1.454.CMB.1.raw
  modified_base (775)..(775): a, c, t, g, unknown or other
  misc_feature (775)..(775): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctcgtgggtccacgcctccgaggggtagtaattgtgctgtactctacgtcctacctacgtacctttcgagttcgtgtacgtacctaaccgaaagggaacgtaaacgtaccaacctactaccgtacccgtccgggccggtaccgtacggtacgaaggtacggttacgggttaggttacggtacgttaccttacgtaccggtacggtaccaacggacgaaacggaaccggaccgtacggtaccgtacgtaccgtaaccgtaacgtcctacctacgtactaacgtaacgttacttaccgttaccctttacccgttaccgttcccgtttaccggtacccgggttacccgggttccccgtacggttacggttcgtacggtcggtacggtaggtacggtacgtcgtacgtacgtaccttaccgtaccctaccctactacctacgtacgtacgtacggtacgttaggaacgtacgtaggaactgacgtactacttacttaacgttacttacgtagtactaagacgttaactaaccgtttacttaccgttactacgtacgttcctaacgtacccgtaccgtacgaaccgtagtacgacgtaacgtagtaaacgttaactacggtagtcgtacgtactacgacccttacgttctaccgttntaaccccg

SEQ ID NO: 171584 - DNA, 841 bp, Homo sapiens
  misc_feature: GYAE6OF01DNT1K.27.78.H01.1.454.CMB.1.raw
tcagagcgtcgtctcacgaccggtgctcgatttagtgtgagtagtttgggtttggggatgagcaaaactgacaagtcaaggcaggagatgttgccatcacaactcattgggtttctgctgctcgtgggttccagcctccgagggtgaaattgtgctgactcagtctccagtactttcagtcgtgtcgactacaaggtagaaacgtccaccagtccacctggcccgggcctagtcaggagtcgttggtagtactccttacgacgttcggaccagcgacgtaacgcctacggctacgtacctaccaacgtctacctccagtactaatactcgtccttcccgtacgtccctttccgtccggtccgggttccccgtcggttaccggtccgtacgggttcggcgtaacggtcggtacgttacggtaccgggacttaacccgttcgtttaccctacccgtaccctaccgtacgttaacctaaaggttacccgtaacgggtaacggttaaccgacggttaaggaaacgtcgttaaccggtccttaacgttaaccgtttaacgtttacgtttaccgacgtttacgaacggttacccgtaagttaacccgtttaaccctttaaccgtttccgttaaccggttaacggttaccgttacccgtttaacccgggttaacccgggtttaacccggtaaccggggtaaaccggttaccccggtaaggggtttaaccgaaaccgggtttaaaccgggttaaaacttaaaccgggttacccggttagggttacccggttacgttaacccggtacccttaacccggttattttaaccggccttttaccggttaccccg

SEQ ID NO: 171585 - DNA, 742 bp, Homo sapiens
  misc_feature: GYAE6OF01APP5W.27.78.H01.1.454.CMB.1.raw
  modified_base (121)..(121): a, c, t, g, unknown or other
  misc_feature (121)..(121): n is a, c, g, or t
  modified_base (183)..(183): a, c, t, g, unknown or other
  misc_feature (183)..(183): n is a, c, g, or t
  modified_base (240)..(240): a, c, t, g, unknown or other
  misc_feature (240)..(240): n is a, c, g, or t
  modified_base (686)..(686): a, c, t, g, unknown or other
  misc_feature (686)..(686): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaanactgttcgccatcacaactcagtttgggtttctgctgctcgtcggtccacgcctcgagggtnaagtgtgctgactcagtcctacctagtacctttgactctgtcaacgtacgaaagganaacgtccaactactacccgaccgtccgggacccggacctagtaccgaacggacggttacggtttaggtacgttaacgttaccttaaccgtaccggtaccggtaaccgacggacggaaacggaacggtaccgaacggtccgtacgtaccttaaccaaccggtccttacctagtactaacttagtacttaccgtaccttcccgttacgttcccgttccgtacccggtacccgggttaccccgtcgggttacgtccggtacgtcgggtacgtacggttcggtacgtcggtacgtacttcttaccgttacccaccccttacgaaccctagtacctaacgttccggtactacgggtaactacgaacggtatcgtacgaccttacgtaattaacccgtttatccgtactacgtacgtacgtactacgtttaccttacgtacctagtaacgtntaccgtcgtaccgtacgtaccgaacgtactacggtagaacggtaagtaacgtacgg

SEQ ID NO: 171586 - DNA, 817 bp, Homo sapiens
  misc_feature: GYAE6OF01CO2Y2.27.78.H01.1.454.CMB.1.raw
  modified_base (139)..(139): a, c, t, g, unknown or other
  misc_feature (139)..(139): n is a, c, g, or t
  modified_base (189)..(189): a, c, t, g, unknown or other
  misc_feature (189)..(189): n is a, c, g, or t
  modified_base (399)..(399): a, c, t, g, unknown or other
  misc_feature (399)..(399): n is a, c, g, or t
  modified_base (599)..(599): a, c, t, g, unknown or other
  misc_feature (599)..(599): n is a, c, g, or t
tcagagcgtcgtctcacgaccggtgctcgatttagtgtgagtagtttgggtttgggatcttaaaagaggttctttctctgggatgtggcatgagacaaaactgacaagtcaaggcaggagatgttagccatcacaactntagttggtttctgctgcgttcgtggttccacgccttaccggaggggttanaagttgtgaccgtgtacgtctacgttccacgtacgttactttcgacgttccgtagtacgtaacctaacggaaaaggaacgtaaacgtaccaacctacttaccgaccgtccggccggaccagtacgtagacggttaggttagtagtacgtaccttagtacgtacggtacacgacacgaacgaccgagtcacgtacaccgaacgtctcctanagttacacgtagttccgtaccttacctacgttccgttacgtacccgggccgttacccgtacgggttcgtacgtacggtcgtaccggaggtttacgacgtcggtacgtaacctacttcccgtttacccctaacccgaccgtaaccttacgtaaccgtacgttaacccggtagtaaccggtaacgtaccggaagtaaccggngtaccgttaacttacggttaaccgtttaaacgtttcctttaagtaccgttaagttaccgttaagaccggttttaaacgttaacctttttaccggttaaaccttaaccgttagtaacccggttacctttaaccccggtaaacccggttaacccgggacccgttaacgggaacctaacggttaaccggttaacggtaaacccgttaaacggggttaaccg

SEQ ID NO: 171587 - DNA, 785 bp, Homo sapiens
  misc_feature: GYAE6OF01D76RI.27.78.H01.1.454.CMB.1.raw
  modified_base (120)..(120): a, c, t, g, unknown or other
  misc_feature (120)..(120): n is a, c, g, or t
  modified_base (770)..(770): a, c, t, g, unknown or other
  misc_feature (770)..(770): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttcngctgctcgtgggttccacgccgtccgaggggtataattgtgctcgactcagtcctccagtactttcagtctgtacgaactaccgaaaggacgaactccacctactccaccgtcggcccggtcagtcaggtacgtcggttggtagtacgtacttaccacgtacggtaccagacaaggaacgcgacggtcacgtaccaccaacgtcctactactatactaagttcgtccgtacctcccgtaccgttcccttcgtacccgggttcccgggttacccgtacggtacgggttctacgggtcggacgtacgggtcgtaacgtccggtacgggtacctaaccttaccttcccgtacccctactaacctactaactacgtacgacggttaacggaacgttacaaggtaagtcgtacgtaccgttactaaaccgtttaactttaacgttaccgttacgtactaacggtaactaacggtttaaaccttacctttaacccttaaccgtaggttaaccgttaacttaccgttaccccgttaaccggtaccgggtaaacggtaccgggtaacgtaacggaacgggttaacgggtaaaccgtttaaaggtaaaccggttcggtaccggttacggtaaccaccgttaacgtaccttaaccggttnttacccgtttacccg

SEQ ID NO: 171588 - DNA, 789 bp, Homo sapiens
  misc_feature: GYAE6OF01D9XN7.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttgggtttggggatgagacaaaactgacaagtcaaggcaggaagatgttgccatcacaactcattgggtttctgctgctcgtggttccagcctcgaggggtataattgtgctgactcagtctccagtactttcagtctgtacgactaacgaaagganaacgtccacactccaccgtcggccgggacagtcgagtagtcggttaggtatagtacttacgacgtggtaaccagacgaagacgccaggtctagtaccacgaaacgcctcctactaactacgaagttactcggtacccttacccgtacggttcccttcggacggtacccgggttcccctagggttacgttaccgaaggtcggtacgtaggttcggtaacttcggtacggtaacctaaccgttaacctttacccgaaccccttacaaacccttaagtaaccgtaacgttaccggtaccgtaagggtaacgtacttaagggaaacgtacttacgtacgtactaaccttaaacgtttacgttaccgttaggtaacctagttaaccgtaaacggtttaaaccttttaacccgtttaacccttttaacgtaacgtaaacggttaccttaaccgtttaccccgttaacggttaaccccgggaacgtaaacgggtaccctaacgggaaacgtaaccgggtaaagtttaaaccgtaaacggtcggttacggaccgtcgtaaccgactaccttacgtcgtttaactccgttaacccg

SEQ ID NO: 171589 - DNA, 775 bp, Homo sapiens
  misc_feature: GYAE6OF01AZZHF.27.78.H01.1.454.CMB.1.raw
  modified_base (187)..(187): a, c, t, g, unknown or other
  misc_feature (187)..(187): n is a, c, g, or t
  modified_base (316)..(316): a, c, t, g, unknown or other
  misc_feature (316)..(316): n is a, c, g, or t
  modified_base (604)..(604): a, c, t, g, unknown or other
  misc_feature (604)..(604): n is a, c, g, or t
  modified_base (732)..(732): a, c, t, g, unknown or other
  misc_feature (732)..(732): n is a, c, g, or t
  modified_base (742)..(742): a, c, t, g, unknown or other
  misc_feature (742)..(742): n is a, c, g, or t
tcagagcgtcgtctcacgaccggtgctcgatttagtgtgagtagtttgggtttgggggggcatgagcaaaactgacaagtcaaggcagggaagatgttgccatcacaactcagttgggtttctgctgctcgtgggttccagcctccgaggggtgaagttgtgctgtactcacgtctccagtcttcgngtctgtagtacctacggaaaggaacgaacgtccaaccactccgtaccgtccggccgggacctagtccgaggtacggtcggttaggtaggtacgtaccttacgtacgtcggacgacggacgaacggaacnccggtaaggtacctacggtaccctaacgaaccgtccctaccactagtactaagttactccgttcccgttaccgtaccgttcccgtttacccgtaccggggtacccgggtttccccgtcggttaacggttcgtaccgggtcgggacgtagggtacggtaccttcgggtacggtacctaacgttcccttacctaccccgtacctacgtacctactaacggtacgtacggtagacggtactaggtaacgtgttaccggtacgtaccgttaccttaaccttgttaacccgtntaaccggtctaaactacggtttaccttttaacgttaaccccttaacgattaagtacccggtttacttacccgttaaccggtagggaaccgtaccggtacgacggtaacgtacggaaagtaaccgttancggttacggngtacgttacgcccttagtacctgttaccctccg

SEQ ID NO: 171590 - DNA, 914 bp, Homo sapiens
  misc_feature: GYAE6OF01AJN9T.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactctattgggtttctgctgctcgtgggttccacgccgtccgaggggtagaaattgtgctgactcagtcctaccagtacttttcagtctggtcgaccgtaaccgaaaagggaagaacgtccaccactaccaccgtcggccgggaccacgtacgaggaggtcggtttaggtagttacgtccttaaccgacgtacggtaaccagacgaaggaacgccgtaacggtaccacgtaccgtaccgaaacgtccctacctactacttaaccgtaaagttaccgttccggttcccctttacccgtaccggtttccccgtttacccggtacccggggttacccgggggtttacccccggttacgggttacgggtttacggtacgggttcgggtacggttaacgggttcgggttacgttaccgggttaccgggtaacccttaaccgtttaccttttacccgtacccccttaaccaacccgtaaccgtaactaaacggttaccggtaccgttaagggtaaacgtacgtaacggtaacgtacggttaccgtacgttaacgtaacctttaaacgtttaacgtttaccgtaccgttaactaaccggttaaccgtaacgtttaaccgtttaaaccctttaaccgttttaacccgtaaaccgtttaacggttaccgttaaccgttaccccggttacccggtttaacccggggaaacccgggttaaaccggggaacccgttaaacgggttaaccgggttaaacgggttaaaccggtttaaaaccgtaaacccggg

SEQ ID NO: 171591 - DNA, 781 bp, Homo sapiens
  misc_feature: GYAE6OF01CTHLX.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccgaaagggagaaacgtcaaccatccaccgtggcccgggccagtcaggagtcggttggtagtagcttacgcgttcggacagcaagaacgcctaggctagtcctaccaaagaccgtcctcactacgtaagtaatcgtaccttcccgtacgttcccgtttcgtccgtacggggttacccccgtacggtacgttacgtaggtcggcgtaggtacggacttcggtacgggtaaccacgttactttaccaaccccttaccaccaactaccaaacgtacgtaccgtagggtaacgtacgtaggaagtagtacggtaccgttacgtaaccttaacgtttaacgttaccgttacgttactacgtaacgtaacggtacgtttaacctttaacccttttaaccgtaacgtaacgtttaccggtaacttaccggttaacccgtttacccgggaaccggttaaacgggacccgtaaccggtaaaccggttaacgggtaaacgttaaaacgggttaaaacccggttaaacggttacgggttaaccgggtacgttacgacccgtaacccgttactttcccgtttaccgtttaccctttaaccccgg

SEQ ID NO: 171592 - DNA, 838 bp, Homo sapiens
  misc_feature: GYAE6OF01EW4X3.27.78.H01.1.454.CMB.1.raw
tcagagcgtcgtctcacgaccggtgctcgatttagtgtgagtagtttgggttgggatgagcaaaactgacaagtcaaggcaggaagatgtgccatcacaactcattgggtttctgctgctcgtcggttccagcctcgagggtataaattgtgctagtactcacgtcctccagtacttcgacgtctagtcgtacctaccgaaagggtacgaaacgtccaaccgtactccaaccggttcggacccggggtacctaacgtaccgaaacggtacggttcgggtttaacgggtacgttaacggtacctttaacgtaccgttacggtaaaccaggtaacgaacggtaacgtaccggtaacggtaccgtaacgttaacccaaccaaaccggtcctaccctaacgtaacgtaaccggtaaaacgtttccgtaacccgttaccgttaccccggttaaccgtttcccgttaaccggtacccggggttacccgggttaccccgttacgggtaaacggtttccggtacgggtacggtacggtaaccggtgggtaaccgttcgggtaaacggaaccgtttaaccccgttacgttttaaccccgaaccctaaccgtaacctaaactaacggttaaaaccgtacggttaccgggtaaacgggtaaccgttactaaacgggtacgttaaggtacgtaacgttacgttaacttaaccgttacgttactacgtagtactacgttaactaccgttaaccttactactacggtaatacgtctaccgtcgacgaacggacgtaacgagtacgagtaaacgtacgtaacgtgtcgacgtcaacgtcatcgattctctacg

SEQ ID NO: 171593 - DNA, 827 bp, Homo sapiens
  misc_feature: GYAE6OF01AU2KC.27.78.H01.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (198)..(198): a, c, t, g, unknown or other
  misc_feature (198)..(198): n is a, c, g, or t
  modified_base (715)..(715): a, c, t, g, unknown or other
  misc_feature (715)..(715): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgnctgactcagtctccatactttcagtctgtcgactaccgaaagganaaacgtccaacctataccaccgtcggccccggggacctacggtacgaaggtacgggttccggttttagggtaagttaccgtaccgtttaaccgtaccgttacggggtaacccaacggaccgaaggtaaccggcccggtaaggtacctaaccggtacctaaccgtaaacgtcccttaccgtactaactacgtaaagtcgttacgtcccttcccgtaccgttcccttccgtccgggtacccgggtcccctaggtacggttccgaagggtcggtacgtacggtaggtcgttaccgggacggtaacctaccgttaccctttacccaaccccttacaaccctaacttaccaaacggttacccggaccggttaagggaaccgttacgtaacgggaaacttcgggtacctaaccggtaacgttaaccgtttaaccttttacgttaccgttcgtaactaccgttaactagttaacccgtttaacctttaccgtttaacgacgtacgtaaccgttacggttacccnccgggttaaaccgccggaaacgtacccgtaagtaccggtaacggtaagttaaacccgtaacggttgtacggaccgtacgtacccgactacttacttcgtacctttctacccg

SEQ ID NO: 171594 - DNA, 902 bp, Homo sapiens
  misc_feature: GYAE6OF01CU11Q.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttggggtttggggggcatgagcaaaactgacaagtcaaggcaggaagatgttgccatcacaactcattgggtttctgctgctctgggttccagcctcgagggtnaattgtgctgactcagtctcagtactttcagtctgtcgactacaaaggaagaacgtcaaccactccacgtcggcccggcagtacagagtcggttaggtagtacgtacctacgacgtacggtaccagacgaagaacgccgaggtacagtacctaccgaaacgtcctacccactaagtaccgaaagttacgtcgtcccttacccgtaacgtttcccttccgtaccggttacccggggttaccccttacgggtacgggtttaccgtacgggttaggccgttaagggtacgggtacgttaccggtacgggtaactaaccgtttacctttaccccaccccgttaaccgaaccctaactacgtaaacgtaccggtaccgttacggaaccggtacgttacgaaaacgtctacggtaccgtaacgttaccttaaaccgtttaacgttaacctttacggtaaccttaacggttaaccccgttaacggttttaaacccgtttaaacccgtttttaaacccgtttaaccccgttaaacggtttaaaccgggtttaaccggttaacccgtttaaacccccgttacccgggttttaaccgggaaaccccgggttaaacgggaccccggtaaaaccgggttaccgggtaaagggtaaaaccggtttaaaaccggttaaaacccggttaacgggttaacggtttaacccgggcgttaacccggtaaccccggttaacccttaccgtttaccgtttccggtttaacccc

SEQ ID NO: 171595 - DNA, 625 bp, Homo sapiens
  misc_feature: GYAE6OF01AEFS8.27.78.H01.1.454.CMB.1.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (483)..(483): a, c, t, g, unknown or other
  misc_feature (483)..(483): n is a, c, g, or t
  modified_base (598)..(598): a, c, t, g, unknown or other
  misc_feature (598)..(598): n is a, c, g, or t
  modified_base (616)..(616): a, c, t, g, unknown or other
  misc_feature (616)..(616): n is a, c, g, or t
tcagagcgtcgtctcacgaccggtgctcgatttagtgtgagtagtttgggtttgggatgagcaaaactgacaagtcaaggcaggaagatgttgccatcacaactcattggtttctgctgctctagggttccagcctccgaggggtcgtaaattggtgcttggaccttcgagtcctccaagtacctttcagttctggtgacctccggaaagngaaactccgacatccacgtcgccgggcngtacgagngtcgtggtagtntccgtttaacgngttcggtaaccgagacagacgccgagtcgacgtcacgaacgcctacctacactacgatctcgtccttcctcgttcctcgtccggtccggtccgtcggtcggttacgcgtcggcgtagtcgtagtacgagtactactcttccacctctaccataccatccgacgtagtacgacgtacgtatacgtgacgtacgtacgttaacttacgttactntacgtctatacgtaacttacttacttactataacgttgtaccgttacgttaccgtacggacgtaacggtacgtaccgtacggttagacgtaaacgtaggtactcggtacgtaccncgtacctacgacttcgtntccgttacc

SEQ ID NO: 171596 - DNA, 821 bp, Homo sapiens
  misc_feature: GYAE6OF01D6GHF.27.78.H01.1.454.CMB.1.raw
  modified_base (150)..(150): a, c, t, g, unknown or other
  misc_feature (150)..(150): n is a, c, g, or t
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagacaaactggcaagtcaaggcaaggaagatgtgccatcacaactcagttgggttcngctgctcgtaggtccagcctcgtaggggtanaattgtcgctgactcacgtcctacctagtacctttacgacggttctggtacgtacctaaccggaaaaggaacgtaaacgtaccaacctagtccgaccgtcggacccgggacctaggtaccgagggtaacgtcggtttacgggtacgtacgtaccgttaacgtacgtaccggtaaccaaggtaccggaagaaccgggtaccgtacgggtcccgtaacgtaccgtaacccggtaacacccttccgttaacaacgttacgtaaacgttacgtccggtacccttaccggaaccgtttcccgtttaccggttcccgggtaaacccggggggttcccccttaggggttaacccgggtttacggacgggttaccgggtaccggtaaggtcggttaacttaccgggtacggtaacccttaacgttaccttacccctaacctaccgtaacccgtataacctaagtaccgtcgttaggaacggtccgtaagtacgtagtgtacctaggttaacttaactttacgtacttacgtacgttacgtacgtacgtacttaccgttttaactaccgtataacgttacttactaacccgtcggttaaccggaccgaaaggtacctaacggtacggtaacggtaataaccgttaacgg

SEQ ID NO: 171597 - DNA, 805 bp, Homo sapiens
  misc_feature: GYAE6OF01CE9OQ.27.78.H01.1.454.CMB.1.raw
  modified_base (775)..(775): a, c, t, g, unknown or other
  misc_feature (775)..(775): n is a, c, g, or t
  modified_base (787)..(787): a, c, t, g, unknown or other
  misc_feature (787)..(787): n is a, c, g, or t
tcagagcgtcgtctcacgaccggtgctcgatttagtgtgagtagtttggggtttgggggggcatgagacaaaactgacaagtcaaggcaggaagatgttgccatcacaactcagtttgggtttctgctgctcgtgggttccagccctccgaggggtagtaattgtgctgactcacgtcctaccgagtactttcagttctgtacgtacctaccggaaaaggaagtaactaccacctacgtaccgtaccgtacgggcccgggtacctaggtacgaggtacggtcgggttttaggtaacgtacgttaccgttacaccggttacggtaccgagacgacggaacgtccgtaacggtactacgtacctaaccaacgttcctacctatactaacgtaacgttcgtaccgttacctcccgttaccgttcccttaccggtcccgggttacccgggttccccgtaggttaccggttagcggtacggtacgtacgggttacgtacggtaccggtaacggtaccttaaccttaccgtttacccccgaaccgttaacccaacgttaccctaacgttaacggtaccggttaccggtaagtaccggttaacgagtaaccggtagtactccgggtaattaccgttaacgttaacttcgtagtactactaacggtacttaaccgtttactttaacctacgtacgtagttactaccgttaccgtacccggtacgaaccggaccgggtacaacggtacgtaaaggtaacctaaaggtaaccgtgaccggttacncgaaacccgttntacttcttcgttcctacg

SEQ ID NO: 171598 - DNA, 871 bp, Homo sapiens
  misc_feature: GYAE6OF01B6J3P.27.78.H01.1.454.CMB.1.raw
  modified_base (734)..(734): a, c, t, g, unknown or other
  misc_feature (734)..(734): n is a, c, g, or t
tcagagcgtcgtctcacgaccggtgctcgatttagtgtgagtagtttgggttgggggatgagcaaaacctgacaagtcaaggcaggaagatgttagccactcaacaactctagtttcgggtttctcgctgctcgtcggttccacgcctccgtaggggtagtaagttggtcgctcgtacgtaccgtacgtccgtacctacgtacctttacgacggtttcgtcggtacggtaccgtaaccggaaaagggaacggtaaaccgtccgtaaccgtaacgtacccggtaacccggtaccggggcccggggtaaccctacgggtaccgtaacgggtagggttaccggttttaacggggtaacggttaccggtaccgtttaaccgtaaccggttaccggtaaccgaacgaaccgtaaacggaaccggtaaccggtaacggtaaccttaaccggtacctaaccgtaaacggtccgttaccctacgtaacgtaacgtaacgttacggttaccgtacccgtttacccgtacgttcccggttacggtaccgggttaccgggttaccccgttacgggtacgttaccggtcggtcggaaccggttggtacgtacgttacgggtacggtaaccttaccgttaaccgttacccgaacccttaccgaaccttacgtaaccgtaaccggttacggacgtaacggtacgtaccggtaagtacgatacgtactacgtaccttaagttcttacgngttaccgactacgacgttactaccgttacgttacgacgttacgacgtactacgtaccgtcgacgacggtacacgtacgaacggtaactaagtaccggagttcgacgtcgcaacctagtaacctcttaacgtcgtacc

SEQ ID NO: 171599 - DNA, 715 bp, Homo sapiens
  misc_feature: GYAE6OF01DL8YB.27.78.H01.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggtcacgcctcgagggtanaattgtgctgactcagtctaccagtactttcagtctgtcgactacgaaaggagaacgcacacnccaccgtcggcccgggactaggtcaggtacggtcgttaggtaacgtacgtcctaacgacgtacggaccgagacgaacgaacgtcgtacgtacgtacgtacctaaccgtaacgtcctacctacgtaacgtaccgtaacgtcgtccgtacccttacccgtacgtttcccgttaccggtacccgggttacccgggttccccgtacgggttacggttacgtacggtcggtcgtaggtcgtacgttacggtacgtaacctaccttaccgttacccgacctaccaactacgtaacgtaacgtacgtacgtagacgtacgtagaacgtctacgtactacgtaacttaattcgtacgtatactacgtacgtaacgttacttaccgttacgttacgaagtactacgtaccttaccgtaccgtaccggaacgaacgtacggtacgtaggtaaacgtaacgtaaaccgtaagtcggcgtaccgtcgaaccctaccgttactacttcgttcctaccgtcc

SEQ ID NO: 171600 - DNA, 819 bp, Homo sapiens
  misc_feature: GYAE6OF01BREY6.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcacaactcagtttgggtttctgctgctcgtcgggttccacgcctccggaggggtagtaaagtttgtgcttagacctctacgttcctcctacgttactttcagttctgtacgacctaacgaaagggtaactaaactccaacctactccgtaaccgtccggacccgggtaccaacgtacgacggtaggttcgggttaaggtacgttacgtacttaacgtacgtacggtaaccgagaacgaaggacgcgtacggtactacgtaccaccgaactcctacgtactactacgtaagtacttccgtaccgttcccgttacgttccgttaccggtacccggttaccgggttaccccgtagggttacggttcggacggttaccggtacggtaaggtcgtacgtacggtacggaccttaacctaccgtttaacccacccctactaacctataacccgttaaggtaccggtacgtacggaacgttactaacggtaagacgttaccgtactaaccgtaacttaacgtttacgttacgtacgtcttaacggtacttaacgttaacccttttaccttaaccgttaccgttaagtacccgtacgttaacccttaccgtccgggttaacccggacgtaacggaaccgtaggtaccggtaaaccggtaagtttaaaccgtaaggtacggttcggacgtaccgacctacacccgttacttacggttcctcgtttaccc

SEQ ID NO: 171601 - DNA, 838 bp, Homo sapiens
  misc_feature: GYAE6OF01CYTN7.27.78.H01.1.454.CMB.1.raw
  modified_base (160)..(160): a, c, t, g, unknown or other
  misc_feature (160)..(160): n is a, c, g, or t
  modified_base (790)..(790): a, c, t, g, unknown or other
  misc_feature (790)..(790): n is a, c, g, or t
tcagagcgtcgtctcacgaccggtgctcgatttagtgtgagtagtttgggtttgggatgagcaaaactgacaagtcaaggcaggaagatgttgccatcacaacgtcatttgggtttctgctgcgttcctgggttccacgccttccgagggtagtaattgngctagactcagtctcctagactttcagtcgtgtacgactaccgaaagggaagtaacgtccaccactccgaccgtacggcccggacctagtcgaacggtcggttaggttcggtaagttacgtactttaccgaccgtttacggaaccgagaccgaaggaaccgtccgtagacttaacggtacctaaccgaactcctaccgtactataaccgttagttacgtcccgtcctttacccgtaccggtttcccttacggtccggtacccgggttaccccttagggttacgtaccggtagtacgtgtaggttacgtacgttcggtaacgggaccttaccttaaaccttccccgtaacccttacgaaaccgttaacgtaccgttaaacgtaccgaccgttaacgggacgtaaccggtaagtaacggtacgttgtaaccgttaacgttaaacccgttaggttttacccttaagttccgaacgtttacgtaaccggtttaatacccgtttaacttttacccgttaaccctaacggttaacgtaaccgttccgtaacgttacccggttaaccggccggttaaaccccgtaaggtaaccgtacgttaggaaaccgttaaaaccgtttaggacgggttttaccncggttacccacggtacccttacgtctttaaccttgtccgttaaacccg

SEQ ID NO: 171602 - DNA, 773 bp, Homo sapiens
  misc_feature: GYAE6OF01BFXDM.27.78.H01.1.454.CMB.1.raw
  modified_base (119)..(119): a, c, t, g, unknown or other
  misc_feature (119)..(119): n is a, c, g, or t
  modified_base (151)..(151): a, c, t, g, unknown or other
  misc_feature (151)..(151): n is a, c, g, or t
  modified_base (158)..(158): a, c, t, g, unknown or other
  misc_feature (158)..(158): n is a, c, g, or t
tcagagcgtcgtctcacgaccggtgctcgatttagtgtgagtagtttgggttgggggcatgagcaaaactgacaagtcaaggcaggaagatgttgccatcacaactcagtttggtttcngctgctcgttgggtaccagcctccgagggtanaattcgngctgactcgacgtcctaccgagtactttcgagttcgtggtcgaacccgtaaccgaaaagggaactaaacgtaccaaccctactaccggaccccgtcgggcccgggacctaacgtacgaaggtagtaccggtttaggtagttaccggttactaaccgcgttaacggtaaccgaagaccgaaacgaccggaccgtaacggtacaccgtacctaaccgaaacgcccttacgtacctaagtaacgtaagttcctaccgtcccgttacctaaccgttcccttccgtaccgggtccccggttccgtacggtacgttacggtggacggtcgtaaggtggtacgtacggtacggacctaacgttacctacccgaaccctacgtacctaactagttaaaccgtcggtaaccgtaggaccgtcgaagtacggtctagtctaagttaccctattacgtacgtctacgtacctgtaaccgttacttaccgtttaacttaacgttacaacggttaccctacgttaaccgtaccggtacccgaaccgggaacgtaccggtaaccgtaagttacggtaaactacgtaaacgtgtacggtccacgtacgacgtactcttcgtaacccgtag

SEQ ID NO: 171603 - DNA, 784 bp, Homo sapiens
  misc_feature: GYAE6OF01BOGKY.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctggttccacgcctccgaggggtagtaaattgtgctgactcagtcctaccagtactttcacgtcctgtcgtaactaccgaaaggacgaaacgtcaccatccaccgtcgccggcagtcgagagtcgttaggtagtacgtacttacgacgtacggtaccagacgagaacgccgtaggtcctacgtactaccgaaacgtccgtaccactaactacgaaagttacgtccgtcctttacccgtacgttcccgtttaccgtccggtaacccggggttcccctacggttacggttaccgaggtcggacgtaggtacgtacgtcggtacggactacgtacctttaccaccctacactactacacgtacgtccgtaggacgtcgtagaacgtagtacgtacctacggtaaccttaaacgtttacgttaacgtttactaccgttattaaccgaacggtttaacctttaaaccttttaacccgtttaaccgttaacgtaaggtaccgttaaccttaacccgttacccgggtaacggtaacccggaaaccgggtaaccgtaaccggtaacggtttaaagaaaccgggtttaaaacgttaaacggtacggtttaggtacccggtacgttacccgaaccttaaccttactttccggtttaacgttcctttaacccg

SEQ ID NO: 171604 - DNA, 785 bp, Homo sapiens
  misc_feature: GYAE6OF01ASXOL.27.78.H01.1.454.CMB.1.raw
tcagagcgtcgtctcacgaccggtgctcgatttagtgtgagtagtttgggttggggggcatgagacaaaactgacaagtcaaggcaggaagatgttcgccatcaacaactctagtttgggtttctgcctgctcgtggttccagcctcggagggtagtaagttgtcgcgtgactctacgtcctaccgtacgtacttacgacgttcttaggtacgaacgtaacggaaaaggtaacgaacgtaccaacctacgtccgtaccggtaccggcccggtacctaggtacgaacggtggttacggttaggtagttaccgtacgtaaccgtacgtaccggtacacgacgtaacgaacgcggtacgtactaccgtaacctaactaccgtaccttacctacgtacgtactaacgtacgttcctccgttccgttaccgttccgtacgtccggacccggttccgtacggtcgtacgcggtacgcggtacgtcgtacggtcggtacgtacctacggttaccctacccgacctaccgactacctaagtaccgtacgtacggacgacgtaacgtagtacgtacgtacgtactacgttaaccgttaatttctaaggtcctaacgtacgtttacgtaacgttaacctttaacgttaccgttaacgtacgttaacgtacttacgtacccgttaaccggaccgtaaacggaacgtcggttaaacgtacgtaagtaaaccgtaacgtaacggttcggtaccgtaagtccgtacgttaacgtacctacgttcctaccggtttacccg

SEQ ID NO: 171605 - DNA, 733 bp, Homo sapiens
  misc_feature: GYAE6OF01E2UJF.27.78.H01.1.454.CMB.1.raw
  modified_base (149)..(149): a, c, t, g, unknown or other
  misc_feature (149)..(149): n is a, c, g, or t
  modified_base (155)..(155): a, c, t, g, unknown or other
  misc_feature (155)..(155): n is a, c, g, or t
  modified_base (201)..(201): a, c, t, g, unknown or other
  misc_feature (201)..(201): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtanaattgngctgactcagtcctccagtactttcagtctgtgactaccaaagganaagtcaccatccacctcggccggcagtcagagtcgttaggtagtacgccttacacgtacggtaccagacgaaggaacgccgtaggtccacgtacctaaccaaacgtcctacctactaactacgtaagttactcgtccttccgtacgtttcccttccgtaccggtacccgggttcccctacggtacggttacgaggtacggtccgtaggtacggtacgttacggtacggtaacctacgtacctttacccaccccgttaccaccctaactacgtaaaccgttaccggaccgtaagggacgtacgtaggtaacgtatcgtaccgtacgtacttaacgtttacttaacgtacgttacacgtacgtaacgtaacgtttacccttaactttaaccgtaacgtaacgtacgtaccttaccccgtaccggttaccggaaccgtaacggaccgacggttaacggtacggtaaacgtaaccgttaaacggacggttcggtacggtacacggtacccaacgttattccttacgtccttacccg

SEQ ID NO: 171606 - DNA, 697 bp, Homo sapiens
  misc_feature: GYAE6OF01CM522.27.78.H01.1.454.CMB.1.raw
  modified_base (179)..(179): a, c, t, g, unknown or other
  misc_feature (179)..(179): n is a, c, g, or t
  modified_base (211)..(211): a, c, t, g, unknown or other
  misc_feature (211)..(211): n is a, c, g, or t
  modified_base (496)..(496): a, c, t, g, unknown or other
  misc_feature (496)..(496): n is a, c, g, or t
  modified_base (572)..(572): a, c, t, g, unknown or other
  misc_feature (572)..(572): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctggttccagcctccgaggggtctaaagttgtgctgactcagtctccagtacctttnacgtctgtgactacgaaaggagaacgtcaccntccgactcggcccgggaccaggtcgagtaggtcgttaggtagtagtccttacgcgttacgacaggacagaacggcctaggtctaaggtcctaccgaacgtcctacccgtacacgttccaaagtctccgtccgtttaccctcgttacctttcgccgggtaccggggttcccctaggtagtttccgaggtcggtcgtaggtaccggattccggtaggacctaccgttcttaccctacccgtactacgtactacgtaacggttccaccgtaggaacgtcttagacgtnaacgtcgtcacgttacgtactttatcgtagtctaacgtagtacgttactaaccgttcttaaccctgtaaccggttnacgttccctacggttacccgcggaaaccggacgtacggacgttagggtaaccgtaaagttaaacccggtgggtacctacgggttacctacgtaaccctacccttaggtaccgttggtttaacccc

SEQ ID NO: 171607 - DNA, 880 bp, Homo sapiens
  misc_feature: GYAE6OF01AKMTE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgcttgctcgtcgggttccagcctccgaggggtgaaattgtgctgactcagtctctagtactttcagtctgtcgactaccgaaaggagaagtcaccatccaccgtcggccgggccacgtcgaggtacggtcggtttgggtacgttacgtaccttacgacgtcggtaccgacgacgaacgacgaccgtacggtacgtacgttaccgtaaccgaacgtccctaccctactaacgttacgtaacgttacgttccgtcccgtttacccgtaccgtttaccccgtttacccggttacccgggttaccccggggtttacccccgttaccgggtttaaccgggtttaccggtacgggttacggggtaccgtacgggttaccgggtacggttaccgggtaccgggtaacctaaccgtttacccgtttaccccgtaacccctaaccgtaaccctaaccgtaaccgtaaaccgtaccgtaaccggtaacggtaacgtacgtaacggtaacgtcgtacgtaccgttaacgttaaccgtttaactttacgttacgttacgtaccgtacgtaccgtttaacgttaaccgttttaaccctttacccgtttaaccgtacgttaccgttaaccgtacccgttaccgtaccggtacccggtaacgggaacggtaccgtaaccggtaccggtaaacggtaaaccggttaacgtaaccggttacggtcggttacgtaccgtacgtaccctaccgttaccgttccggtttccgttccgttaccg

SEQ ID NO: 171608 - DNA, 700 bp, Homo sapiens
  misc_feature: GYAE6OF01AG0WL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattggtttctgctgctctgggttccagcctccgaggggtgaaattgtgctgactcagtctccagtactttcagtctgtgactaccaaaggagaaacgtcaccatcacctggccgggccagtcagagtcggttggtagtacgcttacgacgtcggtaaccagacagaacgccgaggtcacgtacctaccaaacgcctacctcaactacaagttactcgtccttccctacgttccctttcgtccggtaccggggttcccctaggtacggttcgaggtcggtcgaggtggtagtcgtaggacctacgtactttaccaccctccgaaccactacaactacgcgtaggaagtacgtagaagtagtgtacgtactaacttaaacgttactttacgttacgtactaacgttaccgtaagttaacgttaacctttaaccgttttaaccgttaacgtaacggttacgtaaccttacccgtaccgttaccgggaaccgaaacgggacccgaacggtaacggtaacggtaaacgttaaacgttaaaccgtacggttggtaccggccgtacgtaaccctaacctaccgttcgttgttccttacccg

SEQ ID NO: 171609 - DNA, 678 bp, Homo sapiens
  misc_feature: GYAE6OF01BJAQM.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagtactttcagtctgtgactccgaaaggagaaagtcaccatcacctggccggccagtcagagtcgttggtagtagcttacactggtaccagcagaagccaggtcagtctccaaagctcctccatcaagtatcgcttcccagttccttctccgcgggtcccctggtagttcaggtcgcaggtggatcgtacgggactacgtactttccacccttcaacctactacaaacgtacgcgttacgggaacgtctaggaagtagtacgccgttagaacccttaatttaaccgttacgtacgttactaacgtcgtaaacggttacgtttaacccttacttttaaccacgttaacgttacgtaaccgttaccttaccgggttacccggaaccggtaacggaacccggtaccggtaaacgtaaccggggtaagtaaacgtttaaaacccggtacgttacgggtaccggtcgttaacgtccgaacccgtaacgtttccctggttttaccgtttaacccg

SEQ ID NO: 171610 - DNA, 787 bp, Homo sapiens
  misc_feature: GYAE6OF01CJ2ZO.27.78.H01.1.454.CMB.1.raw
  modified_base (553)..(553): a, c, t, g, unknown or other
  misc_feature (553)..(553): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtggttcagcctccgagggtgtaattggtgctgactcagtcctacctagtacctttcagtcgtgtcgaacctaccgaaaaggtaacaaacgtccaacctactccacccgtcggcccgggacctaggtcgaggtacggtcgtttagggtaacgtagtccgttaacgacgttaccgggtaaccagaccggaaagacggtccgtaacgggtctaacggtacctaaccgaaacgtcctaccctacgatacgtaacgttagtccttacccgttaccgtccgtttaccgttccgtacccgggttaacccggggttcccctacgggttacggttcgaggtcggtcgtaggtagtacgttccggtaggtaacctacgtccttacccaccctactactactacaacgtaccggtctaacggaagtacgtaggaacgtntccgtcgtaacgtacttaactttcgtactcgtactacgtaacgtagttaaccgtttaacctttaaccgtcccttaacggacttaaccgtacgttacccgtacccggttaacggaccgaaacgggtaccctaacggtacggtaacgggttaaacgttaaaccgggttaaaccgtccggtaaggttcccggtaacgtcgtaaccctccgttaccgttcctttccgttcgtaacccc

SEQ ID NO: 171611 - DNA, 729 bp, Homo sapiens
  misc_feature: GYAE6OF01A34AY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccagacttttcagtctgtgactccgaaaggagaaagtcaccatcacctgccggccagtcagagcgttggtagtagcttacactggtaccagacagaagccaggtcagtctaccaagcctcctcatacaagtatcgccttacccagttcccttcgtcgtacgggtccccctcgtaggttcgaggtcggacgaggtggactcgtcggggtaacaccgtacgttttacccaccccgttaccaaccctacttaccgaaattaccggacccgttagggtaacgccgttaaggaacgtagtacggtactacggtaccttaaacgtttaactttaaccgttacggttactacgttacgtaaacggttaccgtttaaaccttttacccttttaacccgtaccttaaacggtttacgtaaccgttacccgttaaccccggttaccgggtaaccccgtaaagggtaccccgtaacggttaaccggtaacgggtaaacgttaaacgttaaaaccggtacgttacggtacggtacgtaccgactacctacttccgttcgttcccgtttaacccg

SEQ ID NO: 171612 - DNA, 802 bp, Homo sapiens
  misc_feature: GYAE6OF01EFEY8.27.78.H01.1.454.CMB.1.raw
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggggcatgagcaaaactgacaagtcaaggcaggaagatgttgccatcacaactcattggtttctgctgctctgggttccagcctccgagggtgaaattgtgctgactcagtctccagtactttcagtctgtagactaccaaaggagaaagtccaccatccaccgtcggccgggccagtacagagtcgtttaggtagtacgtcttaacacgtacggtaaccagacgaagaacgccaggtcacgtcctaccgaaactctaccttcaatacgtaagtctaccgtcctttaccctacgttccctttaccgtaccggtacccggggttcccctcggtacggtttcgaacggtggacgtaggttggactcggacggacctacgtactttaccaccctacaccatacaagtacgcgtaggatcgtagaaactntgtacgtactaactaacgttactttactcgttactacgtactaacggttacctttaacgttaacctttttacccgtactaacggttacggttaaaccttaacccgtttaaccccgggtaacccgggaaccccggttaaaaggggtaaccccgtaaaacccgggggttaaacccggtaaaggggtttaaaacccggttaaaacccggtttaaaaaaccgggtaacccgtttaccggggttaccccgggttaaccggttaaccccgggttaaaaccctaaacccggttttacccgtttaacccggttttcccgtttaaacccg

SEQ ID NO: 171613 - DNA, 738 bp, Homo sapiens
  misc_feature: GYAE6OF01A4K8N.27.78.H01.1.454.CMB.1.raw
  modified_base (522)..(522): a, c, t, g, unknown or other
  misc_feature (522)..(522): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtacttcagtctgtgactaccaaaggagaagtcacatcaccgtcgccggcacgtacagagtacgttaggtagtagacttaacacgtacggtaccgagtaccgaacggaacggaccgaagggttaccaacgtcctaaccgaaactccgtacctacatacaagttactacgtacccttccgacgttccttacgtcccggtaccggttccccgtacggtacggttaccgacggtacggcgtaggtcggtacgtcggtagggtaccacgttacttaccccaacctaccgaactataacgaataccggaccgttagggaaacgngtaaacgactaagtcgccttacgaacgtttaacctttagtaccgttacgtacctagtacaaacgggtacttaaccttttaacccgttaccgtaagttaacggtttccgtaagtttacccccgttaaaacccgtttccggggtaaaacccgaaaccggggttactaaacccccgggttaaggttaccggaaaaggttttaaaaccggttaaaaccgg

SEQ ID NO: 171614 - DNA, 630 bp, Homo sapiens
  misc_feature: GYAE6OF01BE3SN.27.78.H01.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (601)..(601): a, c, t, g, unknown or other
  misc_feature (601)..(601): n is a, c, g, or t
tcagagcgtcgtctcacgaccggtgctcgatttagtgtgagtagtttgggtttggggatcttaaaagaggttctttctctgggatgtggcatggagcaaaactgacaagtcaagggcaggaagatgttcgccatcacaactcagttgggtttctgctgcgtctgggttccacgcctaccgaggggtgaaattgtgctgactntagtcctaccagtctttcagtctaganacctaccgaaaggagtaaacgtccaccatcncctcggccggcagtcaagtgtcgttggagtacgtctacagtcggacgataccagaactccgaggtctagcctaaccgaatcctcctcgataacgtatacncgtacctcctattccccttcgtcgtcccgggtccctaggtgttaccagggtcgatacggtgacgttcggtagacctaacctnttacccgacccttcaccactactaacggcttcccgnttaaccgntacgagtgtacnccgtaatcttaaaccttgtaccttgacttacgctaaggtacttaaccttaggtttaaccacggtatcccgtagtccgttacccgtacggaccgtaagacccgngaaggtaccgtaaaggtaccttaaacggg

SEQ ID NO: 171615 - DNA, 750 bp, Homo sapiens
  misc_feature: GYAE6OF01BHV6E.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctcagtactttcagtctgtgactaccgaaaggagaacgtcaccatcacctcggccggccagtcgagagtcggttggtagtagcttacacgtcggtaccagacagaacgccgaggtcacgtcctaccgaagcctcctctatacagtatcgtccttcccgtacgttccttcgtaccggtacccggggttccccgtacggttacggttcctagggtccggacgtacggtacggtacgttcgggtacgggtaacctaccttacctttcccgaccccttaccaacccgtaacttaccgtaaacgttacccggtaccggttacgggaaacgttccgtaaggtaacggtacgttaccgacgttacgtaaccgtttaaacctttacgtttaccttacggtaacctacgtactaacggttactttaaccgtttacctttaccgtagttacgtacgttactacccgtaccggttaccggaaccggaacggtaccgtaacggtacgtacggtaaacgttaaacgttaaaccgggtacttcgggtaccgtaccgtaccgtaccgtaaccgttacgttcgtttccgttacgttacccc

SEQ ID NO: 171616 - DNA, 911 bp, Homo sapiens
  misc_feature: GYAE6OF01BJNVV.27.78.H01.1.454.CMB.1.raw
tcagagcgtcgtctcacgaccggtgctcgatttagtgtgagtagtttgggtttgggatcttaaaagaggttctttctctgggatgtggcatgagacaaaaactgacaagtcaaggcaggaagatgttgcatcacaactctagttgggtttctgctgtccttcgttcgggttccacgtccctaccgaggggtataaagttgtcgctgactctacgtcctacctagtactttcagttctgtacgtaacctaaccggaaagggtaacgtaaaacgtcctaaccctactaccgacccgtccgggacccgggtacctacggtaccggaacgtacgggtcggtttaagggtacggtacgtaccttaacacggttacggtaaccgacgaccgaacggaacgtccgtaggtacgtacgtacctaaccgacgtccctacctacgaacttacgtaacgttcgttccgtacccttcccgttaccgttacccgttaccgtaccgggttaccccggggttaccccttacggggttacggttaccggtacggttacgggtacggttacggtacgggtaccgttaccgggtaacggtaacccttaacccgtttacccgtttaacccccaccccgttaaacccctaaccgttaaacgttaaacccgtaaaacgggtcccgggttaaaccgggtaaggttaaacccgtccggttaaacgggacttaccggttaccgtaccgtttaacgtaacccttttaaaactttccgttaccgttaaccgttaactaaccgttaacggttacctaaacccttttaaccgtttacccttaaaccgtaacgtttacgacgttaaccgttcccggtaaaccgttcggaaacccggagtaaccccgtagtaaccggtacggtaaacttaaggtaaacccg

SEQ ID NO: 171617 - DNA, 794 bp, Homo sapiens
  misc_feature: GYAE6OF01AUA3S.27.78.H01.1.454.CMB.1.raw
tcagagcgtcgtctcacgaccggtgctcgatttagtgtgagtagtttgggtttggggatacttaaaagaggttctttctcgtgggatgtgacatgagacaaaaactgacaagtacaaggcaaggaagattgttgccatcaacaactctagtttcggtttctgcgtgtacttcggtcggggttacccacgccgttaccggaggggttagtaaacgttggtgactcggactcgtacgtcctaccgtacggttacctttacgacgttcgtggttacgaccgttaaccgaaaagggtaacgtaaactacacctacgtacccgaccggtcggacccggggcctaaggtccgaaggtacggttcggtacggtaagtaccgttacttaccgtacgtcggtaaccaggacgaacggaacggaccgtacggtactacggtaccaccgtaacgtcctaccttacacgtacgtaagttaccgtcgtaccctccgttaccgttccgttccgtacgggtacccgggtaccctacggtaacgttccgtacgggtcggtaaccgttggtccggtaggttaccgtaacggtactaccgtaccttacccgtacctactacccgactacgttaacgcggtacgaggtacgacgtacagtacgtctccgaactactttaccgtatacgtacaacgttcgaacgttagtaaccgtttacccttacgtaacgtaacctacgggttactacccggttaacgtccggtaccgtaagaccggtaaccgtacgtacgggtaactaaaggtaccgtaacg

SEQ ID NO: 171618 - DNA, 739 bp, Homo sapiens
  misc_feature: GYAE6OF01AYH7B.27.78.H01.1.454.CMB.1.raw
  modified_base (151)..(151): a, c, t, g, unknown or other
  misc_feature (151)..(151): n is a, c, g, or t
  modified_base (712)..(712): a, c, t, g, unknown or other
  misc_feature (712)..(712): n is a, c, g, or t
tcagagcgtcgtctcacgaccggtgctcgatttagtgtgagtagtttgggtttggggggcatgagtaaaactgacaagtcaaggcaggaagatgttgccatcacaactcattgggtttctgctgctctgggttccacgcctccgaggggtnaattgtgctgactcagtctccagtactttcagtctgtgactaccgaaaggagaaagtccaccatccaccgtggcccgggccagtcgagtggtcgttaggtacgtagtccttacacgttcggtaaccagacaaggaacgaccgacgggtcacggtacctacccgaaaagtccctacctctaactaccgtaaagttactcggtccccttacccgtacgttccctttccgtaccggttacccgggtttcccccgttcgggttaacggtttccggtaggttgggaccgtaggttacggtacgttacggtacgggacctaccttactttcccaccccttacaccctaactactaaacgtacgtaccgtggaacgtcgtaacgaaagtgtcgtactacggtaaccttaactttacttacgtcgtactacgttaccaaggtttaaccttaacgtttaccgtttaaccgtacggttaacgtacgtaaccttccgtaccgtaccggtaaccgaacggggtaccaacgggtacgtaggtaaacgtaacgttaaacggtagtcggtgtaccncgtaccactactccgttcttccgttcc

SEQ ID NO: 171619 - DNA, 659 bp, Homo sapiens
  misc_feature: GYAE6OF01BWWEF.27.78.H01.1.454.CMB.1.raw
  modified_base (144)..(144): a, c, t, g, unknown or other
  misc_feature (144)..(144): n is a, c, g, or t
  modified_base (150)..(151): a, c, t, g, unknown or other
  misc_feature (150)..(151): n is a, c, g, or t
  modified_base (156)..(156): a, c, t, g, unknown or other
  misc_feature (156)..(156): n is a, c, g, or t
  modified_base (185)..(185): a, c, t, g, unknown or other
  misc_feature (185)..(185): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggttgggggcatgagcaaaactgacaagtcaaggcaggaagatgttgccatcacaactcagttggttctgctgctctggtccagcctcgagggtanaatgtnntagcnctacgtctcctagtactttcagtctagtnactacaaagggactaacgtacctaccactcaccgtacggaccggtaccaggtacaaggtacggtacgtttaggtagtactacttaaccgactaggaccaagacgtaagaccgtaccgagtcgagtacctacgaacgtcctaccatagctaagtctactcctcctagttcctacacgtcggtaccctggtacgtcgagtcgatacggtancgtacgtaggaactactaccgtacacccacactactacaagtacgaccgagaactagtagaaagttcacgtacggtaataaacctttattaacttaaccggtctacttagaaccgttaataacgtttaacccgtttaacgttacctaacgtaagttaccgtaaaccttcgtaacccggttcgaaaccgacgggtaccaaaggtacctacggaaattaacgaaacgttaggacccggtatccggtaactactaactctcgtacttc

SEQ ID NO: 171620 - DNA, 700 bp, Homo sapiens
  misc_feature: GYAE6OF01A4E0W.27.78.H01.1.454.CMB.1.raw
  modified_base (155)..(155): a, c, t, g, unknown or other
  misc_feature (155)..(155): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctcgagggtagaaagttgngctgactgacgtctccagtctttcagtctgtcgactacgaaaggacgaagtcacactccaccgtcggccggcagcgacgacgttcggttacggtagtactcgttaacgacgtacggtaccgagacgaagaacgcgacggtctaaccgtcacaacgtccttccagtaacgtagtaacgtacgtccgtcccttaccgtacgtttccgttccggtaccgtacccggggttcccgttacggtaccggtttcgagggttacggacgttacggtagtaccgtcggtaacggtacctacgttacttacccgaccccttacaccttaactaacgaacgttcgacggtaacgtaacgtacgtaagacgtagtcgtactagtaacttacgttacttacgtcgtacctataacgtacttaacgttaccttaactacgtaagtacgaccttactaccgtacgttccggaacgtaacgacggtactacggtaacgtaagtaaacgtaagttacggtgtaccgggacacgtacccagtaaccttcttcggttacttccg

SEQ ID NO: 171621 - DNA, 772 bp, Homo sapiens
  misc_feature: GYAE6OF01CFYEW.27.78.H01.1.454.CMB.1.raw
  modified_base (265)..(265): a, c, t, g, unknown or other
  misc_feature (265)..(265): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccacgcctccgaggggtagaaattggtgctgactcagtctcatactttcagtctgtgactacaaaggagaagtcaccatccacgtcggcccggacgacgtcgagtacgtcgggttaggtagtacgtccgttaacnccgtacggtaccgacgacgaagtaacggccgtaggtcgtacgtacctaaccgtaaacgtctaccgtcaacgtactaagtcttcgtaccgttccctaccgttccttcgtaccgggtaccgggttccccgttcgggttacggttacggaggttcggaccgtaggtacggtagttaccggacgggtaacctaccgttacctttacccgaccccttaccaaccttacgttaacgaaacgttaccggaccggtaggaacggtacgttaacggaacgtacgttacggaaccgttacgtaaacgtttaaacttttaccgttaagttaccgttctaacgtaccgttaaacgttacgttttaaacccttttacgtttaaacccgtaacggttacggtaacttccgttaaccgacccggtttacgaaccggtaacgacggtaccgtaggtaacggtaagtaacgttaacggagtcgtaccgtcgtaccgtagacctatttcgtacgttcccttaccg

SEQ ID NO: 171622 - DNA, 710 bp, Homo sapiens
  misc_feature: GYAE6OF01AWAZY.27.78.H01.1.454.CMB.1.raw
  modified_base (675)..(675): a, c, t, g, unknown or other
  misc_feature (675)..(675): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtgaaattgtgctgactcagtcctccagtacctttcagtctgtgacctaccaaagggagaaagtccaccactcaccgtcggccggccagtcagaggtcgttggtagtacgtcttacgtactacgggtaccaggacaacggaacgccggaacgggttaccgacggttcctaacccgaaaggccctacccctactactacgtaaagttacgttacgtcccttacccgtacgtttcccgttacgtaccggtaccggggttccccctcgggtacggttcgtaggtcggcgtaggtcggacgtcggtacgggtactacctacgtttacccacccgtacctaaccgtactaacctaacgtacgaccgtaaggtacgagtaggaagtacgtcgtacgtacgtaccttaactttagtacctgtcatacgtaactacgttaccttaacttaccctaagtaacgtcgtaccttaccgtacgttaccgggaccgtaagggaccctaggtaccgtaggtaagtaaccgtaacggacttcggnggtacctcgtactaccgagttctgttaccgttacc

SEQ ID NO: 171623 - DNA, 725 bp, Homo sapiens
  misc_feature: GYAE6OF01A9M8C.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactccgaaaggagaagtcaccatccacctggccggccagtcagtagtcgttaggtagtagcttacgacgttggtaccaggtacaagaacgccgaggtctacgtcctaccaaaagccttccgtaccaatacgaaaggttactcggtaccttccccgtacgttcccttacgtccgtacggggtccccctagtacggttcaggtcgcgtaggtgatcgtaggacactactttaccaccctcaacccgtatacctaaacgtacgaccgtacggaagtccggttaagaaggtactaggtacctacggtacccttaaactttgtttaaccgttacgtcctaaacgttctaagttaaccggttaacctttaacctttaccgtactaaacggttacgtaaccttcgttaacccgttaccggggtaccgtaacgggtaaccgaaacgggtacgttaacgggtaacggtaaacgttaaaaccggtaccggttagggtacgggtaacctcggtaaccctaccgttacctccgtttacgtcccgtttaccg

SEQ ID NO: 171624 - DNA, 900 bp, Homo sapiens
  misc_feature: GYAE6OF01AKVJK.27.78.H01.1.454.CMB.1.raw
  modified_base (118)..(118): a, c, t, g, unknown or other
  misc_feature (118)..(118): n is a, c, g, or t
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
tcagagcgtcgtctcacgaccggtgctcgatttagtgtgagtagtttgggtttgggggcatgagcaaaactgacaagtcaaggcaggaagatgtgccatcacaactcattgggtttcngctgctctgggttccagcctcgaggggtnaacttgtgctgactgagtcnccagtctttcagtctgtgacctaccgaaaagggagtaaacgtccacctacgtccgacccgtcggacccgggcctaaggtccaggacgttccggttaggtaacgtacgtccttaacacgttcggtaaccacggacaaggaccgtccgtagggtcctacggtacctaaccaaacggtccctaccctcgtaaacgtacctaaaggtcttccggtacccttccgtcgttaccctttcgtccgggtacccgggtccctacggtacggttacgacggttgaccgtaggtcggtacttcggacgtactaactttctttacccacctactacctactacgtaactacggccgttaaggaacgtcgtaagtaacgtcgtcgttaacccgtaggtaaacccttaagtttttaccgttaaccggttacgtttaacctaaccgtaaccggtttaacgggtttaaaaccccttttaaccccgtttttacccgttaaacggtttaacccgttaacggggttaaaccctttacccggttacccccgtttaaaccggggttaccccggtttaaaacccggggtaacccgggaaaaccccgttaacgggttaaccggttaaacccggggttaaaccgtttaaaacccgtttaaaaccccggggtaaacgttttccgggggaaaccgtccccgggtttaaaccaacccctttaaacccggtcttttaccccgggttaccgttttaaccccg

SEQ ID NO: 171625 - DNA, 882 bp, Homo sapiens
  misc_feature: GYAE6OF01CB0GI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcaacaactcagttgggtttctgcttgctcgtcggttccagtcctccgaggggtgtaaattgtgctgactcagtcctctagtactttcgacgttcgtgttcgaacctacggaaacggtacgtaaacgtcctaacctacgtaccaccggtcggcccgggaccgtaggtacgaggtacggtacggtttaggtaacggtcgtaccttaccgtacgttacggtaaccacggacgaacgaaccgtaccgtacggtacgtacgtaccgtaaccgactcctaccgtactaacgtacgtaacgttccgtaccgttacccgttacccgtacccgtttccgtaccgttaccggggtaccccgggttacccggttacggttaccggtacggtacggtacggtacggttagtaccggtacgttacggtaccggtaaccgtttaaccgttacccttaaccccgaacccgttacccgtaaacgttaccgtaaccgtacgttaccggtaccggttaacgggtaaccgttacggtaacggtaacgtcgttacgtacgtaaccgttaactttacctttacgtaacgttacgtacgttacgttaccgttaccgtttaaccgttttaacccgttaacgttacccgtaacgtttacgaccttccgtacccggtaacggttacccgacggttaaccggaaccgtacgggtaacggtaaacgttaaacggttaaaccgtacggttacgttacgggtccgtacgaaccgtaccgttaccgtccgtttacgttccgttcccggttaccg

SEQ ID NO: 171626 - DNA, 756 bp, Homo sapiens
  misc_feature: GYAE6OF01AN8CN.27.78.H01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctggttccagcctccgagggtagaaattgtgctagactcgagttcctccagactttcagttcgtgtgacctaccgaaaaggagaaacgtcaaccgatcgaccgtcggccggaccagtcaggagtccggttggtagttacgtcttacgacgtggtaaccagcacgtaagccaggtcagtacaccaaacgctacctcatacgaagtactcgtccttacccacgtttccgttcctaccggtacccgggttcccccgttacggtacggttcgaggtcggcgtacgtagacggttacgtcgggactaaccgtacgtttcctaacccnccctaacgtaactaccaatacggtaccgtaaggaacgtaccggttagaaggtagtccgacgttacggtaaccttaaactttaaccgtttacttacggtaaccctagttaaccgtaagtaacgtttaaccgttaaccttttaacccgtacttaagggtacttacgtaacccgtttacccgttacgggtaaccccgtaacgggtaccgtaacggaacgttaccggtaaaaggtaaacccggtttaaaaccgacgttacgggtacgtacccggtactacggttaaccccagtttcttacccgttctttaaccccg

SEQ ID NO: 171627 - DNA, 602 bp, Homo sapiens
  misc_feature: GYAE6OF01AYAVK.27.78.H01.1.454.CMB.1.raw
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
  modified_base (366)..(366): a, c, t, g, unknown or other
  misc_feature (366)..(366): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactccgaaaaggagaaaacgtcgaacccatccaacctggccgggccagtcagagcgttaggtagtancttacacgtggtaccagcaagaacgccgaggtcagtccgtacaaagctccnatcaatactcgccttcccagtccttcgtcgacgggtcccctggagtcaggtgcagtgatcgnggacactagttccaaccctcaaccgatacaactacgacctaggaacgctagaacgtagtcgtactacgaactaactttactactgtactatacgaagtaactaaccttaactttaaccgacgtaagtcgtaacctcctaacgttaccggaccgaaaggaccaaccggtacgtaaggtaacgaaacttaaacgacggtgtaccggactacggaccacgttactgttccgttctaccg

SEQ ID NO: 171628 - DNA, 663 bp, Homo sapiens
  misc_feature: GYAE6OF01D2OAW.27.78.H01.1.454.CMB.1.raw
  modified_base (176)..(176): a, c, t, g, unknown or other
  misc_feature (176)..(176): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctcagggtnaaattgtgctgactcagtctccagtactttcagtctgtcactaccgaaaggagaacgtcaccatcacctcgccggccagtcagacgtcgttaggtagtagtcttacacgtcggtaccagcgaagacgccaggtccacgtcctaccaaagtcctcctactactactaaggtactcgtcctacccgtacgttccttactccggtaccgggttcccctggtacggttcgagtggccgaggtcggtagtcgtggaactacttacttacccgaccctaccactactacaactaccgaccgttagggaactcgtaggaacgtctcgtacctacgtaccttaactttcgttaccgttgtacacgttacgtacgttaccttaacctttacctttaccctagttaacgtcgtaacttacccgtaccggttacccggaaccggtaaacggtacccggtaacggaaccgttagggtaaacgttaacgttaaaacccgg

SEQ ID NO: 171629 - DNA, 1146 bp, Homo sapiens
  misc_feature: GYAE6OF01E032N.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtctccagtacttcagtctgtcgtactccgaaaggagaaagtcaccgactccacctcggaccgggtccagtcagtacgtcggtttggtaacgttacggctttacgaacttcgggtaacccaggaccaaggaacgccgaagggttaccgacggttaccttaccaaaacggtcccttaccccgtactacttaacgtaacggttaacgttcggccccttttaccccggtaacgtttccccgtttaccgtttcccgggtaacccggggggtttcccccctttaccgggtaacgggtttccggtaacgggttcggggtacgtaacgggttcggggtaacgttcccgggttaacggggggaaccctaaacggttacccgttttacccgtaaccccccttaacccgtaaaccccctaacgttaacccggtaaaccttaccgggtaccccggtaacggggtaaaaccgtacccggttaaggtaaaacggtacgtttacccgggtaaccgttaccgggttaacccgttaaaacccctttttaaacgttttaacccgttaaccgggttttaaccccttaaaggtttaaccccggtttaaacgggttaaaacccggtttttaacccctttttaaaaccccggttttttaaaccccccggtttaaaccccgttaaaaacgggttttacccgggttaaacccggttttaaccccgtttaaccccccgggtttttaaaccccgggggaaaaccccgggttaaaaacccgggggtaacccgggttaaaacccgggttaaacccggggttaaacggggttaaaaaccccggtttaaaaccgggtttaaaaaaccccggtttaaacccgggtttacccggggggtttaaaccggggtttaacccgtaaaccccccgggggtttaccttaaaacccccccggttttaaccgttttaacccggggtttcccctttttaaacccccggtttttaacccccggg

SEQ ID NO: 171630 - DNA, 876 bp, Homo sapiens
  misc_feature: GYAE6OF01DFPQ2.27.78.H01.1.454.CMB.1.raw
tcagagcgtcgtctcacgaccggtgctcgatttagtgtgagtagtttgggtttggggggcatgagacaaaactgacaagtcaaggcaggaagatgttgccatcacaactcattggggtttctgctcgctcgtgggttccagcctccgaggggtagaattgtgctgactctacgtcctaccgagtacttctagtctgtacgactaaccgaaaggaacgtaaacgtacaaccactccgaaaaccgtcggacccgggaccaggtacgaaggtacggttcggttagggttaacgtacgtaccgttactacgtacggtaccgaacgacgaacggaacgtaccgtaagggtactaaccggttacctaaccgtaaacgtcctacctacgtaacgtaacgtaacgttacctccgttacccctttacccgtaccgttcccgtttacccggtacccggtaccccgggtaccccgttaccgggtacggttaccgagggttccggacggtacggtacggtacgttacggacggtaactaccgtaccttaaccctaccctacaaccgtactaaccgtaacggtacgtaccggtaaggtacgtaacggtaacggaacggttacgtacgttaccggtaacttaacttaaccgtttacgtacgtttaacgtaacctaacgttacgtaacggtaacctttaacctttaacgttaaccctaggttaaccgtaccgttaacctacccggttacccggtaacccgggtaaccggtaaacgtaacccgtagggttaacccggtaaagggtaaaccggttaaaccgtaaaacgggttcgttacggtacccggtaccgtaaccgtacgtaacccgttacgttaccgttccggttacccg

SEQ ID NO: 171631 - DNA, 803 bp, Homo sapiens
  misc_feature: GYAE6OF01COQ3H.27.78.H01.1.454.CMB.1.raw
  modified_base (147)..(147): a, c, t, g, unknown or other
  misc_feature (147)..(147): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtcctaccagtactttcagtctgtcgacctaccgaaaggaagtaactccaaccataccaccgtcggcccgggcctagtcgaggngtcgttaggtagtactctacncgtacgtacagacaagacgctacggtctactcctaccaacgcctcctactatacgtaagtactcgtaccttcccgtacgttcccttccgtccggtacccggggttcccctacgggtacgttcggtacggtcggacggtgttacggactcgggtaccggaactaccgttaaccgttccctaacccctacctaaccggtaactaccgtaaacgttaccggtacccggttaagggacgtacggtaacggtaacgtcgttacggtaccgtacggttaaaccttaaaccgtttacgttaccgttaaccgtaacttaaccggttaaccgtaacggttaacccttttaacctttaacccgtttaccctaacgtaacgttcccgttaccgtaaaccccgttcccgggttacccgaacgggtaaccgggccttaacggaaaccgggtaagtaaaccggtaaaccgttaacgggtaccgttcgggtacgtacccgttaccgtaacccgtacctttagttcccggtaacccgttcccttaacccgg

SEQ ID NO: 171632 - DNA, 791 bp, Homo sapiens
  misc_feature: GYAE6OF01CVN7H.27.78.H01.1.454.CMB.1.raw
  modified_base (151)..(151): a, c, t, g, unknown or other
  misc_feature (151)..(151): n is a, c, g, or t
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaaagaggttctttctctgggatgtggcatgagacaaaactgacaagtcaaggcaggaagatgttgccatcacaactcattgggttcngctgctcgtgggttccagcctcgagggtanaattgtgctgtactcgacgtctacctaagtcctttcgagttcctgtacgaacctacgaaaagggagaaacgtcaaccatccaccgtcggaccggccagcgagagtcgttggtagtgtacgttactacgtcggtacagacagacgaccgagtcacgtctacaacgtctactcatactaagtatcgtcctacctacgttccttccgtcggtacccggtccccctagggtacgtacggtcggcgggtagtaacggtcggtaagttcggtacggactacccgtttacgttcccctaacccgtacctaacccgtacttaaccgtaaacgttaccggtacgtacgggtaaccgtaacgtagaaccggttagtcggttaccgtacggttaaccctttaaacgttaacggtttaacccgttagtaccttaaacggttacccggtaaacttaaccggttttaaaccttttaaccgtttaccccgtaaagttaacggttaaccccggttacttaacccccggtttaaaccggtttaccccgggaaaccccgtaacgggtaaacccggtaaaccgggtaacggttaaaacggtaaacgttaacggtttaaaaaccccgggg

SEQ ID NO: 171633 - DNA, 962 bp, Homo sapiens
  misc_feature: GYAE6OF01BBRMR.27.78.H01.1.454.CMB.1.raw
  modified_base (245)..(245): a, c, t, g, unknown or other
  misc_feature (245)..(245): n is a, c, g, or t
tcagagcgtcgtctcacgaccggtgctcgatttagtgtgagtagtttgggtttgggggcatgagcaaaactgacaagtcaaggcaggaagatgttgccatcacaactcatttgggtttctgctgctcgtgggttccagcctccgaggggtagtaattgtgctcgactcgagtcctccagtacctttcagtctgtgacctaccgaaaggagaaacgttccaacctatccaccgtcggccgggaccnggtacaggaggtcggtttaggtacgtcgtccttacgacgtcggtaccaggacaggaacgcccgtaggtacacgtacctaccgtaacgcctacctcacgtacgtaagtcgttccgttaccttaccccgtacgtttcccgttcccgttacgggtaccccgggttacccccgtacgggtaaccgggttgtaaccgggtcgggtaccgtgggtacgggtaccttcggggtaacggtaccctaccgtttaacccgtttacccctaaacccccttacccgaacctaaacccgtttaacccgttaacgggtaacccgttacccggttaaagggggaacccggttgttaaaccggggtaaaacggttacggtttacccgtaaccgggttacccgttaaaacccttttaaaacggttttttacccggttttaaacccgttcgggtaactttaaacccgttcgggttaaaccggttttaacccctttttaaacccgtttaacccctttttaaccccggttaaacgttaacgggtttacccgttaaaccgttttccccggtttaacccccggggtaaccggggtaaccggtaaacccggggtaaaccttacccggggaaacggtaccggttaaaaccggttaaacgtaaacccgggtaacggttttccgggaacggtttaccgtaccccgtaaccttaaccctcgtttacgtttaacccggtttcccg

SEQ ID NO: 171634 - DNA, 808 bp, Homo sapiens
  misc_feature: GYAE6OF01AY4DO.27.78.H01.1.454.CMB.1.raw
tcagagcgtcgtctcacgaccggtgctcgatttagtgtgagtagtttgggttgggggcatgagcaaaactgacaagtcaaggcaggaagatgttgccatcacaactcattgggtttctgctgctctggttccagcctccgaggggtgaaattgtgctgactcagtctccagtactttcagtctgtcgactccgaaaggagaaacgtcaccatccacctcggccgggccagtacagacgtcggttggagtacgctacacgtggtaccagacagaacgccgtaggtcacgtcctacgaaacgtcctacctactactaccgaagtcgtacgtccttacccgtacggttcccttcgtacggtcccggggttaccccctcggtacggttaccgtggtcggtaccgtagggtacggtactaccggtacgggacctacgtacctttcccgacccctaccacctaccggtacctaagtaccggtccggtaacggaacgttcggtaaggaagtaactccggtacgttacccggtaattaaacccgtttactttacggttcctaacgtacttaacgtaacgttaaccgttaacccggtttaaacctttacccggttaagtacggttaacgtacccgttaccttaaccggtccccgggtaaaccggtaaacgggtaccctaaacccgggttaagggttaacccgggttaaaccggttaaacgtttaaaacccgggtccggttttaaaccgggccgggttacccgttaaacccgggtaccctaacccttaccggggttacccttttccggtttaaacccc

SEQ ID NO: 171635 - DNA, 717 bp, Homo sapiens
  misc_feature: GYAE6OF01BNRBF.27.78.H01.1.454.CMB.1.raw
  modified_base (202)..(202): a, c, t, g, unknown or other
  misc_feature (202)..(202): n is a, c, g, or t
  modified_base (394)..(394): a, c, t, g, unknown or other
  misc_feature (394)..(394): n is a, c, g, or t
  modified_base (690)..(690): a, c, t, g, unknown or other
  misc_feature (690)..(690): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctcgggttccagcctccgaggggtgtaaattgtgctgactcgagtctccagtactttcagtctgtgactacgaaagganaagtcaccatccactggccggcagtcagagtcgtttggtagtacgtcttacgacgtacggtaccaggacgaaggaacgtccgaggtccacgtacctaccgaaacgtcctcctacaataccgtaagtcttacgtccttacccgtacgttccctttccgtccggtaccgggttccccgtaggtacggttaccgnggtggacgtaggtacggtactcgggtacggtacctaacgttactttaccctaacccctacctaaacccgtacgtaacctaaacggtaccggtaccgtaagggtacgtaccgtaaggtaaggttacgtacggtaccgtaggttaacctttaacttttaacgtttaccttagttaccaacgtttacgtaacttaacgtttaacctttacgtttaacctacgtaagttactacgttacctacggttccgaacggtaacgacacgtacgtaaggtaacgtaacgtaacgtcgtgtaccgngacgtactacttatcttcgtctacccg

SEQ ID NO: 171636 - DNA, 953 bp, Homo sapiens
  misc_feature: GYAE6OF01D50W3.27.78.H01.1.454.CMB.1.raw
tcagagcgtcgtctcacgaccggtgctcgatttagtgtgagtagtttgggttggggatacttaaaagaggttctttctctgggatgtggcatgagacaaaactgaacaagtcaaggcaggaagatgttgccatccacaactctagtttgggtttctcgctgcttcgttcgggttaccacgccgtaccggaggggtagtaaattggtgctagtactctacgtcctactacgttacttcgagttctgtacgaacctaaccgaaaggtaacgtaactaccaacctactacccgtaccggaccgggtaccccgggactaaggtaccgtaagggtacggttcgggtttaaggttaacgttacgttaccgttaaaccgtacggtacggtaaccaggtaacgaacggtaacggtccgaacggttaccgtaacgttaccgtaaccgtaaacgtcccttaacctactaaacgtacgtaagtttacctccggttacccttaacccgttacgtttaccccgttacggtacccggggttacccggggtttccccgtaagggtttaccggttacgtacggggtacggtacgttaacgggtttacggtaccggtttaaccgggtaacgggttaaccttttaaaccccgtttacccgtaaaccccttacgtaaacccgtttaactaaacccgttaacgttaaccgggtaccgtaaacgggaacgttaccgtaaggtaacgtcgttactaccggttaacgttaaacctttacgtttaaaccgttcgttaaccgtactaaaccgttagttaaacccggtttacctttaacctttaaacccttttaacggaaacgttacggttaaccgtacccgtttacccgggttaaccggtacccgggaaacggttacccgggaaacctcgggttaaacgtaaaccgggtttaacgttaaaaccgttacggggtaaccg

SEQ ID NO: 171637 - DNA, 810 bp, Homo sapiens
  misc_feature: GYAE6OF01A2A86.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagtaaattgtgctgacttcagtcctccagtactttcagtctgtcgacctaccgaaaggagaaacgtcaccgatccacctggccgggacagtcagacgtcggtttggtacgtagcgttacacttcggtaaccgagacaacgtacggacccacggttcacggttaccgacccaaagtcccttctaccagtaccgtaacgttactcgtacccttaccgtacgttcccttaccgtacccggtacggggttcccccttacgggttacgttaccgtagggtccggtacgtaacggttcgggaacgttcgggaacgggtacctaccgttaactttccccgacccttaccaacccgtactaacctaagtaccgtaccgtacggacgtaccgtagaacggtactcgacgttacgtaccttaacgtttactttacgttacgtaccttaataccgtaacgttaccgtttaaacccttttaaccgttttaacccgtaacgtaaaccgtttccgttaaccgttaccccgttaaccccggttaaccggaaccgggtaaacccggaaccgtaaccgggtaacggtaacggttaacggttaaaccttaaacgggtaacggttcggacgggtaccttacgtaaccccgtacttaacgtttaccttcggttcccttaaccgg

SEQ ID NO: 171638 - DNA, 881 bp, Homo sapiens
  misc_feature: GYAE6OF01BAA2S.27.78.H01.1.454.CMB.1.raw
  modified_base (655)..(655): a, c, t, g, unknown or other
  misc_feature (655)..(655): n is a, c, g, or t
tcagagcgtcgtctcacgaccggtgctcgatttagtgtgagtagtttgggtttggggatacttaaaagaggttctttctctgggatgtggcatgagacaaaaactgaacaagtcaaaggcaggaagtatgttcgccatcaacctaactcgtagtttgggtttctgctgtctcgtcggttccgacgtccctacggtaagggtataaagttgtgtctcgtactctacgttcctaccgtaagttacctttcgacgttgtgtacgaacctaaccgaaaaggaacgtaaccgtaccaaccgtactaccgtaccggtcggacccggtaccgtacgtaccgtaggtacggttaggtttaacggtaacgtacgttaccgtaacctaacggttacggtaaccgtagaaccggaaggaacgaccgtacggtccgtaccgtaccgtaaccgtaacgtcctaccgtactaaacgttaactacgttacgttaccgttacccctcccgttaacgttcccgtttaccggtacccgggttacccggttcccggttacgtacggtttacggtcggtacggtcgtaggtcgttacgtcggtacgtaccttacgtaccttacccgtaacccgtactaacccgtaacttaacgtactaccggtcggtaaacggtnacggttaacgacctcggtactaccggtaactttaacccgtaagttttaacacgttaacgttacccttaagttaaccgtaacctttaaaccgtttcttaaacccggtttactaacggtttaacgccccgtttaaacggtaccccgtaaccccggggttaacgaacccgggttaaaccgtacgggtaacgtaccggggttaaaacaacggtttaaacgttaaacgggg

SEQ ID NO: 171639 - DNA, 759 bp, Homo sapiens
  misc_feature: GYAE6OF01ASIUM.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgtctgctcgtcggttccagcctccgaggggtagtaaattgtgctcgactcagtcctccagtactttacagttctgtacgactaccgaaaggaagaaacgtacgaacctactaccgtacccgtcggtacccgggcctacgtacaggtacgtcgggtttaacggtacgtacgtccttaacgtaccgtacggtaccagtacgaacggaacgccgtaggtactacgtacctaaccgtaaacgtcctccgtacacttaactaaacggttacttacgtccttcccgttacgtttcctttaccggtccggtacccggtttcccgtacggttaacggttccgtagggttacggacgtacggttacggacgtttacggtacgaaccgttaccgttaaccttaccctaaccctacctaaccgacttaacgtaacgtaccggtacgttagggactacgtaaggacgtactcggtaacctacgtaaccttaaccgtttataccgtaagttacgtaacacgtaacgttaacttacctttaacgttactacgaacgttctacgtccgttacggtacgaccgaagtccgaggtacgtaagaacgttaagtaacgtactcggtacgagtccgactacttactaccgtgttaccgttac

SEQ ID NO: 171640 - DNA, 795 bp, Homo sapiens
  misc_feature: GYAE6OF01D061X.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactctatttgggtttctgctgctcgtcgggttccacgcctccgagggtataattgtgctgactcagtcctacagtactttcagttctgtcgactaccgaaaggacgaaacgtaccaccatccgaccgtacggcccgggccagtacgaggtacggtcggttaggtagtacgtcttacgacgttcggaacgacgacgaacgacgaccgtacggtacacgtacctacaacgtcctacctactaactacgtaagtctaccgtccttacccgtacgttcccgttaccgtccgggtacccgggttcccctagggtacggttacgaggtcggacgtaggtcgtacgtcggtacggacttacgttaccttacccgtaccctctaacctactaacgtaacgtacgacgtacgggaacttccggtaaggactaagtccgtacttaacgtaactttaaaccgtttattacgttacgtactaacgttacgtaaaccgttaaccgtttttaaccttaacccgttttaaccgaacgtttaacggtaccttaccgtttaacccggtacccgggttaccgggtaaccgggaacggttaaaccgtaacgggtacgtaagggttaaaacccgtaaacggttaaaccgttcggtacgggttaaccgccttaacccgtaccttaacttccgtacctttcttcccggttacccc

SEQ ID NO: 171641 - DNA, 738 bp, Homo sapiens
  misc_feature: GYAE6OF01ES4KQ.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccgaggggtanaaattgtgctgactcagtctccagtactttcagtctgtgactaccgaaaggacgaaaagtccaacctataccgaacccgtcggacccggggaccaaggtccaaggtacggtccggtttaggtaagtacgtaccttacgaccgtagggtaaccaggacaacgaacggaccgtaaggtctacgtacctaccgaaacgtcctacctctaactacgtaagttacgttcgcccttacccgtacgttccctttaccgtaccggtacgggttccccctacggtacggttcgacggtcggtcgaacggtgtaagtcgtacggtactaacgtcttaccacccttacaaccgtactaacgtaaagtccgtacgtacggaacgttcgtaaggaagtacgtacgttaaccttaacgttaactttaacgtttacgttacgttactaacgtaactaaggttaactttaaccgtttaactttaccgtacgtaagttaccgtacttacccgtaccgttaccggacgtaacggacctagtaacggtagtaacgtaacgtaaacgtagtacgtcgactacgtacctacgtctacgttctcgtcttaccg

SEQ ID NO: 171642 - DNA, 756 bp, Homo sapiens
  misc_feature: GYAE6OF01AKNBN.27.78.H01.1.454.CMB.1.raw
  modified_base (608)..(608): a, c, t, g, unknown or other
  misc_feature (608)..(608): n is a, c, g, or t
  modified_base (635)..(635): a, c, t, g, unknown or other
  misc_feature (635)..(635): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctcgtgggtccagcctcgaggggtataattgcgctgactcgacgtctccgagtacttgagtctgtacgactacgaaaggagtaaacgtccacctactcaccgtcggccggcagtacgaggacggtacggttagtacgtagtaccgttacacgttcggaaccaggacgaacggaacgaccgtacgggtactaccggtttacccaaccgtaaacgtcccttaccttacgaactaacgaaacgttacgtccgtaccctttaacccggtacctttcccgttaccggtaacccgggttaccccgggtcccccgttagggttacgttaacggtcggtacggtaccgtaggggttcggtccgtaggtacccggaacttaccttaaccgttccctaccccacgtacctaactacgtaacgtccgaaccggtagacggtacgacgaagtcgtacgtcgtaanaccttttaacgtcgttagtaccgttanaacgttacccgtattaactttacccgtaactttaccggacttacggtacgtaccctacttacccgggtacggaaacctacgggtaaccaccggttaataacggtacgtaaaacgttaccgg

SEQ ID NO: 171643 - DNA, 726 bp, Homo sapiens
  misc_feature: GYAE6OF01DOWWR.27.78.H01.1.454.CMB.1.raw
tcagagcgtcgtctcacgaccggtgctcgatttagtgtgagtagtttgggtttggggatcttaaaaagaggttctttctctgggatgtggcatgagcaaaactgacaaagtcaaggcaggaagatgttgccatcacaactcagttgggtttctgctgctcgtgggttccagcctccgaggggtagtaaattgtgctgactctagtcctccagtactttcagtcctgtcgacctaccgaaaaggaagaaacgtccaaccactacctacccgtcggcccgggcagtacgagtacggtcgtggttagtacgtcttaactacgtacggtaaccgagacgaaggaacgccgtaaggtcctacgtcctaaccgaaacgtccgtaccctacgaactacgtaacgtagtcgtccttacccgtcttccttcgtacgacggggttcccctcgggtacgttaccgtacggtggacgtcggtaggtactacggtacgggtactaacgtaccgtttaccctacccgtacccacgtaactacgtaaacgtacccgtaccgtaagggaccgtacgtaagtaacgtactcgtactacgtaaccgttaactttacttacgtacgtaactacttacgtaccggtaacttaccgttaactttacccaagtacgtactaacgttcctaaccggttacccgaacggaaggtaacccgaacgaggtaacgaacgttaagtaaaaccgg

SEQ ID NO: 171644 - DNA, 608 bp, Homo sapiens
  misc_feature: GYAE6OF01BH9AF.27.78.H01.1.454.CMB.1.raw
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagtactttcagtctgtgactcaaaggagaagtcacatcacctgccggccagtcagagtcgttggtagtagcttacactggtaccagcagaacgcaggtcagtctaccaaagctcctacatcaagtatcgtccttaccctagttcccttctcgtaccggggttcccctacggtacggttcgaggtcgggcgtaggtcggtacgtcgtagggactactctttaccaccctacacctactacaactacgaccgtagggaacncgtaagaacgtntcgactcgacttaaacttattactcgtacatacgagtacttactttaccttaaccgtactaagtgtactaccgtacccgttacggacctaagggacctacgacgtagaagtaacttaaacggacgttggtacggactacgtaccaaccttagtcttacgttctacccg

SEQ ID NO: 171645 - DNA, 786 bp, Homo sapiens
  misc_feature: GYAE6OF01ET12R.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcatttgggtttctgctgctcgtgggttccacgcctccgaggggtagaattgtgctgactcagtcctccagtactttcagtctgtagacctacgaaaaggaagaaacgtccaccactaccaccgtcggacccggccaggtcaggtaggtaccggtttaggtaacggtacgtacttaaccgaccgtacggtaaccaaacgaagaaccgccgtaggtacgtaccgttacctaacccgaaagttcccttaccctataacgttacgaaagttactcccgttcccttaccccgttaccgttccctttccggtaccgggttaccgggttccccgtacggttacggttacgagggtcggaccgtaggttacggacgttccgggtacggaaccttaccttacgtttaccccaccccttacgacctaactacccgtaaactaccggtaccgttaaggaaccgtcggttaaggaactggttaccgttaccgttaacgttaacttttaacgtttaacgtttaccgtgttaaacctagtaaccggtacgtttaacgtttaacccttaaccgtttactaacgtacttacgacttaccgtacccgtacggaacgaacggtaacctggtaaaccgtagaaacgttacgtaagtacgtcgacgtctaccgactacgttatccgtgtcccttaccg

SEQ ID NO: 171646 - DNA, 681 bp, Homo sapiens
  misc_feature: GYAE6OF01CGHWF.27.78.H01.1.454.CMB.1.raw
  modified_base (158)..(158): a, c, t, g, unknown or other
  misc_feature (158)..(158): n is a, c, g, or t
  modified_base (523)..(523): a, c, t, g, unknown or other
  misc_feature (523)..(523): n is a, c, g, or t
tcagagcgtcgtctcacgaccggtgctcgatttagtgtgagtagtttggggtttgggggggcatgagacaaaactgacaagtcaaggcaggaagatgttgccatcacaactcagttgggtttctgctgctcgtgggtccagcctcgagggtgaattgngctgactcacgtctaccagtactttcgagtctgtacgactacgaaaggagaacgtcaccataccgaccgtcggccgggcagtcgaggacggtcggttaggtacgtacgtaccttacgacgtacgtaccagacaagacgcgacgtacacgtcctaccactctccactactacaacgttactccgtcccttcccgtacgttccttccggtaccggtcccgggttcccctaggtacgtacggtggtcggagtacggtcggtacgcgtacgtacctactaccttacccaccctacactactactaacgtacgtcggtaagtaacgtacggtaagtaaggtctacggtactacgttaaccttaacgtttnttaacgccttaacagttaccgataaccttctttacctaactacgtactctaactcccgttacggaccgtaacggacgtaccgacggaagttaggtaaacttaaacggtaacgtacggtggtaacccgagtaccgactaccttcgtccgttcgttaccc

SEQ ID NO: 171647 - DNA, 755 bp, Homo sapiens
  misc_feature: GYAE6OF01A151O.27.78.H01.1.454.CMB.1.raw
tcagagcgtcgtctcacgaccggtgctcgatttagtgtgagtagtttgggtttggggatacttaaaagaggttcttttctctgggatgtggcatgagacaaaactgacaagtcaaggcaggaagatgttgccatcacaactcatttgggtttctgctgctcgtggtccagcctcgaggggtgaattgtgctgactcagtcctaccagtactttcgagtctgtacgacctaccgaaaggaagtaaacgtccaaccacttccaccgtcggacccgggcacgtacgaggacggttcggttaggtagtactcgttacgacgtacggtaccacgacaacggaacggaccgaggtacgacgtacctaaccgaacgtcctacctacactacgtaagttactcgttcccttaccgtaccgttcccgttccggtacccgtaccgggttccccgtaggtacggtcgtacggtcggtacgtaggtacggtacgtacggtacggacctacttaccttaccctacctaccaactactacgaaccgtagaccgtaaggaccgtacgtagaacgtacgtacggacgtacgtaacctttaactttacgtacgttcgtaacttacgtaacgtaacgtttaacctttaaccgtttaccctttaaccgtaacgttaaggttacccttaccgttacccggttacccggtaaccgggtaccgaacgggtaaccgtacggtaacgttaacgggtaaacgtttaaacgttaaaccggg

SEQ ID NO: 171648 - DNA, 695 bp, Homo sapiens
  misc_feature: GYAE6OF01A8CDV.27.78.H01.1.454.CMB.1.raw
  modified_base (548)..(548): a, c, t, g, unknown or other
  misc_feature (548)..(548): n is a, c, g, or t
  modified_base (613)..(613): a, c, t, g, unknown or other
  misc_feature (613)..(613): n is a, c, g, or t
  modified_base (666)..(666): a, c, t, g, unknown or other
  misc_feature (666)..(666): n is a, c, g, or t
tcagagcgtcgtctcacgaccggtgctcgatttagtgtgagtagtttgggtttgggggcgatgagcaaaactgacaagtcaaggcaggagatgtgccatcacaactcattcggtttctgctgctctggttccagcctcgagggtgaattgtgctgactcagtctccagtctttcagtctgtgtacctaccgaaaggtacgaaacggtcaaccaattccaccgttcggacccgggaccctaggtaccaggtagtcgggtttaggtacgttagtcttacgacgtacgtaccagcagacgtcctaggtcagttcctaccgaaacgcttcctctacgtctaacggttatccgtacctttcccgaagttccgttcgtaccgttacgggggtcccccttggaccggtttcgtacggttcgcggttaagttcgggtacgtacgtagggttaccacgttaactttcccgaacctacgaaccctagttacagttagcccgttaagagtactacgaagtcgtcgactacacgtttaacttgtttacacgtcagtaacncgtaacttccgtttaaccttactacggaattcgaccttacgttcccgtaggtaacccgcggttanaaccccggagttacggtaacttaccgttaacgacggtcgttacgcccggttanaccgtaccgtttactccgttcgtaaaccc

SEQ ID NO: 171649 - DNA, 849 bp, Homo sapiens
  misc_feature: GYAE6OF01BQUB1.27.78.H01.1.454.CMB.1.raw
  modified_base (785)..(785): a, c, t, g, unknown or other
  misc_feature (785)..(785): n is a, c, g, or t
tcagagcgtcgtctcacgaccggtgctcgatttagtgtgagtagtttgggtttggggatgagacaaaactgacaagtcgaaggcaggaagatgttcgccatcaacaactcatttgggtttctgctgcttcgtcggtccacgccgtccggaggggtagtaaagtttgtgcgtacgactacgtacgtcctaccgtaacgtactttcagtcgttagtacgaacctaaccgaaaagggtaagtaaactaccaacctaactaccgaccgtccgggacccggtacgaacgtacgaggtacggttcggtttaagggtagtaccgttaccttaccgaacggttacggaaccgacgacgtaacgacggaccggtaggtaccgtaacgtacctaacctaaacgtcccttacctacgtacttaacgtaacgttcgtccgttacccctttacccgttacccgtttcccgtttccggttacccgggtaccccgggtttcccgttacgggtacggtttcgagggttccggagtacggtacggtacgtacggtacgtaaccttaccttactttcccgacctacgaactactaacgtaacgtacgtaccggtaagactacggtaagtaacgttcagttacgtaacttaacttaaacttgttaaccgtctacgtactacgttaacgttaactttaccttaacgttacgtacgtaagtccgtaactcccgggttaaccggtaccgaaccggtaacgaccggtaagttaccgggttaaaacgtacgttaaaccggtttaaacgnggttccgggaagaccccggtttacaacccgtttaccctagttttccttacgttaccccttaacg

SEQ ID NO: 171650 - DNA, 855 bp, Homo sapiens
  misc_feature: GYAE6OF01C5BQS.27.78.H01.1.454.CMB.1.raw
  modified_base (168)..(168): a, c, t, g, unknown or other
  misc_feature (168)..(168): n is a, c, g, or t
  modified_base (832)..(832): a, c, t, g, unknown or other
  misc_feature (832)..(832): n is a, c, g, or t
tcagagcgtcgtctcacgaccggtgctcgatttagtgtgagtagtttgggttgggggcatgagcaaaactgacaagtcaaggcaggaagatgttgccatcacaactcattggtttctgctgctcgtggttccacgccgtccgagggtagtaaagttgtgtctgacctnacgtctcctagttacctttcagttcgtagtaccgtaacctaacccggaaaaggtaaagtaaaccgttacccaacccgtaacttacccgaacccggttcccgggaccccggggacccgtaacggtaccgtaagggtacggttacgggttttaagggtaaggttaaccggtacctttaaccgtaccggttacggtaaacccgagaaccggaaacggaaccggtaccggtaacggggttacctaccggttaaccctaaccgtaaaacgtccctaccctaactaacgtacttaaacggtcttccgttacccttacccgtccgttccttccggtaccgggttccccgggtacccgtacggtacggttacggtacggtcggtcgtaggtcgtaacgtcggtacggtaacttaccgttacctttaccccaccctaacctaccgttaactaacgtaacgtacggtacgtaacggtacgtacgtaacgagtacgtacgttacgtaaccgttacttaactttacgttactacgtactagtaactacgttaaccttactttaacctacgtacgtacgttacgtactaccggtaccggttacgaacggtaaccgaccgtaacggtagaaccggttaaactaaggttaaccgtcgtaacggtcgtacctacgtaacnctttacgtccgttcgtttaaccc

SEQ ID NO: 171651 - DNA, 839 bp, Homo sapiens
  misc_feature: GYAE6OF01AXHXZ.27.78.H01.1.454.CMB.1.raw
  modified_base (154)..(154): a, c, t, g, unknown or other
  misc_feature (154)..(154): n is a, c, g, or t
  modified_base (199)..(199): a, c, t, g, unknown or other
  misc_feature (199)..(199): n is a, c, g, or t
  modified_base (698)..(698): a, c, t, g, unknown or other
  misc_feature (698)..(698): n is a, c, g, or t
tcagagcgtcgtctcacgaccggtgctcgatttagtgtgagtagtttgggtttgggatacttaaaagaggttctttctcgtggatgtggcatgagacaaaactgacaagtcaagcaggaagactgtgccatcacaactctagtttcgggtttcngctgtccgtcgttcggttccacgccgtacgagggtataagtttgngacgtgacctcgacgtcctacctaacgttactttacgacgttcgttggtaccgaaccgtaacggaaaaggtaacgtaaactacccaaccgtacgtacccgtaccggtccggacccggacgtacggtacgaggtacggtttacggtttaggtaacgtacttacctacgtacgttacggaccgagtaaccgaacggcgaccgtacggtactaccgtaccaaccgtacgtcctaccgtacactacgtacgttacgtccttacccttaccgtaccgttccttaccggaccgggtaccccggtttccgtaacgggttcggtcggtaggtccgtagggtacggttagtcgttaccggtaacggtaccctttaccgttaccttaaccccgtaacccctactaaacccgtaactaacgttaaccgtccgtacggtaacggtaacctgtaaacgtaacgtcgtaactccgtaacgttacccttttaagttacccgacttcccgttaanaaccgttattaacccgtttaaccgtttactttaacccgttacaaacggtttacgtccttaacccggtacccgttacccgggaaagtaaacccgggtcgaaaccgtttaagtaaccggtaagttaaacgtaacggttaacgg

SEQ ID NO: 171652 - DNA, 733 bp, Homo sapiens
  misc_feature: GYAE6OF01ESQ8X.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggatgagcaaaactgacaagtcaaggcaggaagatgttgccatcacaactctattgggtttctgctgctcgtgggttaccagcctcgagggggtnaaattgtgctgaccttcgagtcctaccagtactttcagttcgtagtgaactaccgaaaaggtacgaaacgtcaaccagtccaccgtggacccgggaccaggtacaggagcggtttaggtaacgtagcttacgaacgtggtaaccagcgagtaagccgaggtacacgtcgtaccaaagtcctacctacaactacgtaaacgtattcgtaccttaccccgtacgttacctttccgtaccgtacggggttcccccgttaggtacggtttccgaaggttggaccgtaggtacgggtataccggtttacgggaaccctacctaacgtttaccaaccccgttaccaacctaacgtactaaactacggaccgttaggaacggtactaagagtacgtcgacttacgactttaacttaagttaccgtagtctaaagtctaagttaacgttacctaactttaacccgtagtaaagtcgtaacctacgtacccgtaccggacaacgggtacaacgtaccgtaagggtaactaaacggttaaacgtacgtacggttacggtagtaacacctacgtataccgttagtcctttaacg

SEQ ID NO: 171653 - DNA, 783 bp, Homo sapiens
  misc_feature: GYAE6OF01AR22D.27.78.H01.1.454.CMB.1.raw
  modified_base (218)..(218): a, c, t, g, unknown or other
  misc_feature (218)..(218): n is a, c, g, or t
  modified_base (351)..(351): a, c, t, g, unknown or other
  misc_feature (351)..(351): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctcgtcgggttccagcctccgaggggtagtaaattgtgctgactctagtctccgagtactttcagtctgtacgactacgaaaggagaaagtccactanacctaccgtggcccggaccacgtacgaggtacggttcggttaggtacgttaaggtacttaccgacgttacggtaaccgacgactaaaggaacgtaccgacggtacgactaccgtaccgaaacgtctcccttanactaactaacgtagtccggtaccttcccgtacgtttcccgttcctaccggtacccggggttaccccgtacggttaccggttacgtagggtacggacgtcggttaggacgttcggaacggttaccgtaaaccgttactttacctaacccccgctaaccgtaacttaccgtaaacgtacgttaccgaggtaacgtacccgtaggaaacgtggttcgaaccgtactaactaactttacttatacggtactaacgtcgttaagtaaccttacgtttaccttaacgttagtaacgtacgtacgtaaccttccggtaacccgtaacggtaacggtaccgaaacggttacgtaacggaaggttaaaaccgtaaccggtaacggttggtaacccggttagtcccgtaacgtactaccgtttactccgtttaccgttaacc

SEQ ID NO: 171654 - DNA, 725 bp, Homo sapiens
  misc_feature: GYAE6OF01DYPYI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaattgtgctgactcagtctccagtactttcagtctgtcactaccgaaaggagaaagtccaaccatccaccgtcggccgggcagtcagtacgtcggttggtagtgcttacgacgtacggtaccagacagaacgccgacggtactacgtcctaccaaacgtctcctacagtacaagtacgtcgtccttaccctacgttcccttaccgtccggaccgggttcccccgtaggtaccggttctacggtcgcgtaacggtggactcggtacggacctactaccgtttccaccctacgacctactaccgaatacgcgtaggtaacgcgtaaggaatacgtacgacgttacggtaaccttaactttacgttaccttagtactaaccgttacgtaacggttaaccttaacctttaacccgtttaccgtaacgtacgtacgtaccttaccgtaccccgttacgggaccgtaacgggaacctacgggtaaccgttaaaggtaaacggttaaaccgttaaacgtacgggttacggtacggtacccgtaccgttacctaacttaccgtttccggttcttacccgttaacccg

SEQ ID NO: 171655 - DNA, 674 bp, Homo sapiens
  misc_feature: GYAE6OF01BCDG1.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaacgtcaccataccaccgtcggcccgggccagtcgagaggtcggttagggtagtacgtcttacgacgtcggtaccaggcaagaacgccgtaggtccagtcctaccaaagcctcctcatacgaagtactcgtccttcccacgttcccttccgtacgtccggggttcccctacggtacggttcgaggtggacgtaggtgactcgtagggacacgtacttccaccctacacctactactactacgcgtaggaacgtcgtaaggtacgtacgtcgtactacgtaccttaacgtttacttacgtcgtacacgttactaacgttacttaactttaccttaacctacgtaacgtacgtacctacccgtaccgtaccggaaccggaacggtacctacggtaacgtagggtacgtaacggttaaacggtcgttaggtacggtacctcgggtaccctaacgtcgttcgttccgtttaccg

SEQ ID NO: 171656 - DNA, 749 bp, Homo sapiens
  misc_feature: GYAE6OF01DTMS5.27.78.H01.1.454.CMB.1.raw
  modified_base (142)..(142): a, c, t, g, unknown or other
  misc_feature (142)..(142): n is a, c, g, or t
  modified_base (222)..(222): a, c, t, g, unknown or other
  misc_feature (222)..(222): n is a, c, g, or t
  modified_base (310)..(310): a, c, t, g, unknown or other
  misc_feature (310)..(310): n is a, c, g, or t
tcagagcgtcgtctcacgaccggtgctcgatttagtgtgagtagtttgggtttggggatgagcaaaactgacaagtcaaggcaggaagatgtgccatcacaactcattgggttctgctgctctgggttccagcctcagggtnaattgtgctgactcagtctccagactttcagtctgtgactaccaaaggagaaagtcaccatcactgccgggccagtcagngtcgttggtagtagcttacactggtaccagcagaagccaggtcagtctaccaaagctcctcatcaagtatcgcttcccagttcccttnccgtacgggtcccctggacgttcagtggctagtggaactcgtacgggactaacgtactttaccaacccttcgaaccctaacttaccgaaaacgtttaacggtaccccgtttaagggaaaacggtccgtttaaccgggaaaacggtaagtttcggtacccgttaacgggttaaacccgttaaaacccgtttttaactttaaacccggtttacgggttacctaaacgtttaccgaaaccggtttaacggtttaacccgtttaaccttttaaacccgtacgttaaacgttcgtaacgttaccctacccgtttaccgggaccgtaaacggggaaccctaacggaacgttacgggaaacgttaaacgtttaaaaacccggaacgtttcgggtaaccggtcgtttaacgaccgtaacccctatttcccgtccgttcgtttaaccc

SEQ ID NO: 171657 - DNA, 495 bp, Homo sapiens
  misc_feature: GYAE6OF02IDB2T.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttccagtccttctcagggtccctcgagttcagtgcagtggatctgggacacatttcaccctcaccatcaatagctggaagctgaagatgctgctaacttatactgtcatcagatactacttactcagtgatcaccttcggaccagggacacgactggagataaacg

SEQ ID NO: 171658 - DNA, 497 bp, Homo sapiens
  misc_feature: GYAE6OF02IVU0X.27.78.H01.1.454.CMB.1.raw
tcagagcgtcgtctcacgaccggtgctcgatttagtgtgagtagtttgggtttggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggaccaagggacacgactggaagattaaacgactgtggctgcacatctgtc

SEQ ID NO: 171659 - DNA, 504 bp, Homo sapiens
  misc_feature: GYAE6OF02GKPPR.27.78.H01.1.454.CMB.1.raw
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgcaacttatactgtcatcagagtactactttacctnaagtgatccaccttcgacaaggacacgactgganataacg

SEQ ID NO: 171660 - DNA, 500 bp, Homo sapiens
  misc_feature: GYAE6OF02I6I6H.27.78.H01.1.454.CMB.1.raw
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatgcctggaanctgaagntgctgcaacttattactgtcatcagagtactactttacctcaagtgatccaccttcggaccagggaccacgactgggaataattaacgactgtggctgccacatctgtc

SEQ ID NO: 171661 - DNA, 501 bp, Homo sapiens
  misc_feature: GYAE6OF02F72RG.27.78.H01.1.454.CMB.1.raw
  modified_base (463)..(463): a, c, t, g, unknown or other
  misc_feature (463)..(463): n is a, c, g, or t
  modified_base (495)..(495): a, c, t, g, unknown or other
  misc_feature (495)..(495): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtgcagtggatctgggacacatttcaccctcaccatcaatagcctggaagctgaagatgctgctaacttattactgtcatcagagtactactttaccnagtgatcaccttcgacaaggacacgactgganataacg

SEQ ID NO: 171662 - DNA, 499 bp, Homo sapiens
  misc_feature: GYAE6OF02IKWSZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaagctgaagatgctgcaacttattactgtcatcagagtactactttacctcaagtgatcaccttcggccaaagggacacgactggagaattaaacgaactgtggctgcaccatctgtcttc

SEQ ID NO: 171663 - DNA, 504 bp, Homo sapiens
  misc_feature: GYAE6OF02IYPTJ.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttcaccctcaccatccaatagcctggaagctgaagatgctgacaacttattactgtcatcagagtactactttacctcaagtgatccaccttcggaccaagggacacgactggagtaattaaacgactgtggctgccaccatctgtcc

SEQ ID NO: 171664 - DNA, 512 bp, Homo sapiens
  misc_feature: GYAE6OF02JASK8.27.78.H01.1.454.CMB.1.raw
  modified_base (417)..(417): a, c, t, g, unknown or other
  misc_feature (417)..(417): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgagacacatttccaccctcaccatcaatagcctgganctgaagatgctgacaactttattactgtcatcaagagttactactttacctactaagtgatcaccttcggaccaagggaccacgactggataacg

SEQ ID NO: 171665 - DNA, 500 bp, Homo sapiens
  misc_feature: GYAE6OF02HEBN3.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctnaagtgatcaccttcggaccaagggacacgactggaagattaaacgaactgtaggctgcacatctgtc

SEQ ID NO: 171666 - DNA, 493 bp, Homo sapiens
  misc_feature: GYAE6OF02HBYCX.27.78.H01.1.454.CMB.1.raw
  modified_base (194)..(194): a, c, t, g, unknown or other
  misc_feature (194)..(194): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagntgctgacaacttattactgtcatcagatactactttacctcaagtgatcaccttcggaccaagggcacgactggagattaacgatgtgctgcaccatctgtctc

SEQ ID NO: 171667 - DNA, 496 bp, Homo sapiens
  misc_feature: GYAE6OF02HWFK7.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactgtgctgcaccatctgtctc

SEQ ID NO: 171668 - DNA, 516 bp, Homo sapiens
  misc_feature: GYAE6OF02HNISU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtccctcgaggttcagtggcagtggatctgggacacatttcaccctcaccatcaatagcctaggaagctagaagatgctagctaacttattactgtcatcagagtactactttacctctaagtgactcaccttcggaccaagggaccacggactggagtaacttaaacgaactggtagctgacaccatctcgtcttacc

SEQ ID NO: 171669 - DNA, 550 bp, Homo sapiens
  misc_feature: GYAE6OF02HD83S.27.78.H01.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
  modified_base (396)..(396): a, c, t, g, unknown or other
  misc_feature (396)..(396): n is a, c, g, or t
  modified_base (547)..(547): a, c, t, g, unknown or other
  misc_feature (547)..(547): n is a, c, g, or t
tcagagcgtcgtctcacgaccggtgctcgatttagtgtgagtagtttgggtttgggggcatgagcaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccggccagtcagagcgttggtagtagcttacactcggtaccagcagaagccaggtcagtctccaaagctcctcatcaacgtatcgcttcccgagtccttctcgacgggttcccctgtaggttcagtggcagtggatctgggacactatttcacccttcgaccatccaatacgcctaggaacnctagaagatgacttgactacttattaactgttaccatactagagttactactttaccgtacaaagttcgtattaccaaccgtttccgaccaacgggtaccacgtactacggaggacttaaacgaactcgttggcttcgactaccactcgtntcc

SEQ ID NO: 171670 - DNA, 520 bp, Homo sapiens
  misc_feature: GYAE6OF02HTP69.27.78.H01.1.454.CMB.1.raw
  modified_base (465)..(465): a, c, t, g, unknown or other
  misc_feature (465)..(465): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaagctcctcatcaagtatgcttcccagtccttctcaggggtcccctgagttcagtgcagtggatctgggacacatttcaccctcaccatcaatacgcctggaagctagaagatgctgactaacttatactgtcatcagacgttactactttacctntaagtgactcaccgttcggacctaacgggacaaccggactagggatagttaaacg

SEQ ID NO: 171671 - DNA, 498 bp, Homo sapiens
  misc_feature: GYAE6OF02GO19F.27.78.H01.1.454.CMB.1.raw
  modified_base (384)..(384): a, c, t, g, unknown or other
  misc_feature (384)..(384): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggttcccctcgaggttcagtggcagtggatctgggacacatttcaccctcaccatcaatagcctggaanctgaagatgctgcaacttattactgtcatcagagtactactttacctcaagtgatcaccttcggccaagggcacgactggaanattaaacgaactgtggctggcaccatctgtc

SEQ ID NO: 171672 - DNA, 523 bp, Homo sapiens
  misc_feature: GYAE6OF02IY8WB.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctcgaggttcagtgcagtggatcgtgggacactatttcaccctcaccatcaatacgcctggaagctagaagatgctgctaacttattactgtacatcagtagtacttactttaccactaagtgatctaccttcggaccaagggaccaacggactaggagtattaaaccgg

SEQ ID NO: 171673 - DNA, 503 bp, Homo sapiens
  misc_feature: GYAE6OF02GXB75.27.78.H01.1.454.CMB.1.raw
  modified_base (496)..(496): a, c, t, g, unknown or other
  misc_feature (496)..(496): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtgcagtgatctgggacacatttcaccctcaccatcaatagcctggaagctgaagatgctgcaacttatactgtcatcagagtactactttacctcaagtgatcaccttcggaccaagggacacgactgganataaacg

SEQ ID NO: 171674 - DNA, 496 bp, Homo sapiens
  misc_feature: GYAE6OF02FYDW6.27.78.H01.1.454.CMB.1.raw
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagntgctgcaacttattactgtcatcagagtactactttaccncaagtgatcaccttcggccaagggacacgactggagattaaacgactgtgctgcaccatctgtctc

SEQ ID NO: 171675 - DNA, 497 bp, Homo sapiens
  misc_feature: GYAE6OF02HXHNT.27.78.H01.1.454.CMB.1.raw
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaanctgaagatgctgcaacttattactgtcatcagagtactactttacncaagtgatcaccttcggccaagggacacgactgganattaaacgaactgtgctgcaccatctgtc

SEQ ID NO: 171676 - DNA, 498 bp, Homo sapiens
  misc_feature: GYAE6OF02FLDYU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagataaacgaactgtggctgcaccatctgtcttc

SEQ ID NO: 171677 - DNA, 497 bp, Homo sapiens
  misc_feature: GYAE6OF02G0UK0.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctnaagtgatcaccttcggccaagggacacgactggagattaaacgactgtggctgcaccatctgtctc

SEQ ID NO: 171678 - DNA, 494 bp, Homo sapiens
  misc_feature: GYAE6OF02JATSU.27.78.H01.1.454.CMB.1.raw
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagntgctgcaacttatactgtcatcagtagtactacttacctcaagtgatcaccttcggccaagggcacgactggagtattaaacgactgtgctgcaccntctgtctc

SEQ ID NO: 171679 - DNA, 498 bp, Homo sapiens
  misc_feature: GYAE6OF02I5WJQ.27.78.H01.1.454.CMB.1.raw
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaagctgaagntgctgactaacttattactgtcatcagatactactttaccacaagtgatcaccttcggaccaagggacacgactggagattaaacgactgtggctgcaccatctgtcttc

SEQ ID NO: 171680 - DNA, 525 bp, Homo sapiens
  misc_feature: GYAE6OF02J2X8V.27.78.H01.1.454.CMB.1.raw
  modified_base (229)..(229): a, c, t, g, unknown or other
  misc_feature (229)..(229): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcaggggtcccctgaggttcagtgcagtggatcngggacacatttcaccctcaccatcaatacgcctagganctagagatgctgcaacttattactgtacatcagtacgttactactttaccacagtcgactcctaccgttcggaccaacgggacaccggtactacggtagtattaaaccgg

SEQ ID NO: 171681 - DNA, 496 bp, Homo sapiens
  misc_feature: GYAE6OF02H97RR.27.78.H01.1.454.CMB.1.raw
  modified_base (382)..(382): a, c, t, g, unknown or other
  misc_feature (382)..(382): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgcaacttattactgtcatcagagtactactttacctcaagtgatcaccttcggccaaagggacacgactggagattaaacgactgtgctgcacatctcgtntc

SEQ ID NO: 171682 - DNA, 495 bp, Homo sapiens
  misc_feature: GYAE6OF02HA17W.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctacaagtgatcaccttcggccaagggacacgactggagattaaacgactgtgctgcacatctgtctc

SEQ ID NO: 171683 - DNA, 490 bp, Homo sapiens
  misc_feature: GYAE6OF02ILLRZ.27.78.H01.1.454.CMB.1.raw
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
  modified_base (484)..(484): a, c, t, g, unknown or other
  misc_feature (484)..(484): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtgcagtggatctgggacacatttcaccctcaccatcaatagccctggaanctgaagatgctgcaacttattactgtcatcagatactactttacncaagtnatcacttcgccaaggcacgactgganattaaacgactgtggctgccacntctgtc

SEQ ID NO: 171684 - DNA, 576 bp, Homo sapiens
  misc_feature: GYAE6OF02GBBT4.27.78.H01.1.454.CMB.1.raw
  modified_base (196)..(196): a, c, t, g, unknown or other
  misc_feature (196)..(196): n is a, c, g, or t
  modified_base (398)..(398): a, c, t, g, unknown or other
  misc_feature (398)..(398): n is a, c, g, or t
tcagagcgtcgtctcacgaccggtgctcgatttagtgtgagtagtttgggtttgggggcatgagcaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttgggtagtagccttacacctggtaccagccagaagccaggtcagtctccaaagctcctccatcaagtatcgcttcccagtccttctcgagggttcccctgaggttcagtgcagtggatctgggacacgtatttcgacccttcacccatccaatacgcctaggaacnctagaagatgcttgactaacttattactgtcatcgtagtagttactacgtttacctacgaagttcgaacgttctacccgttcggaccgaacgggacctacgacgtacgggaagtaaccgtttaaacgaaccgttcggtacggtccgtacggtaccctaccctacttacgtcgttaccc

SEQ ID NO: 171685 - DNA, 490 bp, Homo sapiens
  misc_feature: GYAE6OF02HW0ZZ.27.78.H01.1.454.CMB.1.raw
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctgganctagaagatgctgctaacttatactgtcatcagagtactactttacctcaagtnatcaccttcggccaaggcacgactggagataacgactgtgctgcacatctgtctc

SEQ ID NO: 171686 - DNA, 497 bp, Homo sapiens
  misc_feature: GYAE6OF02GI524.27.78.H01.1.454.CMB.1.raw
  modified_base (429)..(429): a, c, t, g, unknown or other
  misc_feature (429)..(429): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggcacgactggagattaaacgaactgtagctgcaccatctgtcttc

SEQ ID NO: 171687 - DNA, 502 bp, Homo sapiens
  misc_feature: GYAE6OF02F889T.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggagtgagcaaaactgacaacgtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagtagtactactttacctctaagtgatcaccttcggccaagggacacgactggagaattaaacgactgtagctgcacatctgtcttc

SEQ ID NO: 171688 - DNA, 498 bp, Homo sapiens
  misc_feature: GYAE6OF02GP6C9.27.78.H01.1.454.CMB.1.raw
  modified_base (413)..(413): a, c, t, g, unknown or other
  misc_feature (413)..(413): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcagggtccctcgaggttcagtgcagtggatcgtgggacacatttcaccctcaccatcaatagcctggaanctagaagatgctgctaacttattactgtcatcagagtactactttaccnaagtnatcaccttcgcaaggcacgatgganataacg

SEQ ID NO: 171689 - DNA, 495 bp, Homo sapiens
  misc_feature: GYAE6OF02HWA9S.27.78.H01.1.454.CMB.1.raw
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgctaacttattactgtcatcagagtactactttacctanaagtgatcaccttcggaccaagggacacgactggagataacgatgtagctgcacatctgtctc

SEQ ID NO: 171690 - DNA, 496 bp, Homo sapiens
  misc_feature: GYAE6OF02HTVYI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgcaacttattactgtcatcagtatactactttacctcaagtgatcaccttcggaccaagggacacgactggagaattaacgactgtgctgcacatctgtctc

SEQ ID NO: 171691 - DNA, 576 bp, Homo sapiens
  misc_feature: GYAE6OF02JH66R.27.78.H01.1.454.CMB.1.raw
tcagagcgtcgtctcacgaccggtgctcgatttagtgtgagtagtttgggtttgggggtagtgagcaaaactgacgaaagtcaaggtcaggaagatgttgccatcacaactcaattgggttctgctgctctgggttccagcctccagggtgaaattgtgctgactcgagtctccagactttcagtctgtgactccaaaggagaaacgtcgaccagtcaacctgccgggccacgtcacgagcgttggtagtagcttacactgggtaccagcagaagccaggtcagtctccaaagctccgtcatcaagtactcgccttcccgagtccttcgtcacggggtcccctcgacggttcaggtggtccaggtggacgtcgtgggaccactatttccaccctcaccatcaatacgcctaggaacgtctgaaacgtatcgctcgacaacttattactgtcatcagtactacttactttacctactaagtcgactacaccgttcggaccaagggacctacggacgtggagtaacttaaacggactggtacggacctacgacctaccctatccgtacgtccgttacg

SEQ ID NO: 171692 - DNA, 496 bp, Homo sapiens
  misc_feature: GYAE6OF02FXAY8.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattcaccctcaccatcaatagcctggaagctgaagatgctgcaacttattactgtcatcagtagtactactttacctntaagtgatcaccttcggccaagggacacgactggagattaacgactgtgctgcaccatctgtc

SEQ ID NO: 171693 - DNA, 497 bp, Homo sapiens
  misc_feature: GYAE6OF02F10SH.27.78.H01.1.454.CMB.1.raw
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcaccctcaccatcaatagcctggaagctgaagatgctgcaacttattactgtcatcagtagtactacttactctaagtnatcaccttcggacaagggacacgactggagtattaaacgactgtgctgcaccatctgtctc

SEQ ID NO: 171694 - DNA, 514 bp, Homo sapiens
  misc_feature: GYAE6OF02I8XCI.27.78.H01.1.454.CMB.1.raw
  modified_base (368)..(368): a, c, t, g, unknown or other
  misc_feature (368)..(368): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccgggccagtcagagcgttggtagtagcttacactggtaccagcagaagccaggtcagtctccaaaagctcctcatcaaagtatgcttcccagtccttctcaggggtcccctcgaggttcagtggcagtggatctgggacacatttcaccctnaccatcaatagcctggaagctgaagatgctgcaaacttattactgtcattcagagtactactttacctacaagtgaatcacctttcggccaaagggcaacgactaggagaattaaacgaactgtaggctagcaccatctgtcttac

SEQ ID NO: 171695 - DNA, 520 bp, Homo sapiens
  misc_feature: GYAE6OF02FRKLP.27.78.H01.1.454.CMB.1.raw
  modified_base (307)..(307): a, c, t, g, unknown or other
  misc_feature (307)..(307): n is a, c, g, or t
  modified_base (429)..(429): a, c, t, g, unknown or other
  misc_feature (429)..(429): n is a, c, g, or t
  modified_base (472)..(472): a, c, t, g, unknown or other
  misc_feature (472)..(472): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcnccaaagctcctcatcaagtatgcttcccagtccttctcacggggtcccctggacggttcagtggcagtggatcgtgggacactatttccaccctcaccatcaatcgcctaggaagctgaagntgctgactaacttattactgtcatcagtagtacttactttacnctaagtgacttcaccgttcggaccaacgggacacgactggagataacg

SEQ ID NO: 171696 - DNA, 510 bp, Homo sapiens
  misc_feature: GYAE6OF02JBF21.27.78.H01.1.454.CMB.1.raw
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctgaggttcagtggcagtggatcgtgggacacgatttcaccctcaccatcaatagcctggaanctgaantgctgacaacttattactgtacatcagtagtactacttactcaagtgatctaccttcggaccaagggacacgactggacgtataaacg

SEQ ID NO: 171697 - DNA, 496 bp, Homo sapiens
  misc_feature: GYAE6OF02G9X0W.27.78.H01.1.454.CMB.1.raw
  modified_base (429)..(429): a, c, t, g, unknown or other
  misc_feature (429)..(429): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagatactacttacctanaagtgatcaccttcggccaagggcacgactggagaattaacgactgtaggctagcaccatctgtctc

SEQ ID NO: 171698 - DNA, 574 bp, Homo sapiens
  misc_feature: GYAE6OF02F9NTM.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatcgtgggacactattccaccctcaccatcaatacgcctaggaagtctagaagatgctgactaacttattactgtacatcagtagttacttactttacctactaagtgtacttcctaccttcggaccaacggggaccacggaccgtagggaaacgtaaacgttaaaaccggaaccgttaggtacgggtaccgttacggaccctaaccctacgttccgttagttacccc

SEQ ID NO: 171699 - DNA, 496 bp, Homo sapiens
  misc_feature: GYAE6OF02IL2TO.27.78.H01.1.454.CMB.1.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgttgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgctaacttatactgtcatcagagtactacttacnctaagtnatcaccttcgaccaaggacacgactgganagttaacgactgtgctgcacatctgtctnac

SEQ ID NO: 171700 - DNA, 529 bp, Homo sapiens
  misc_feature: GYAE6OF02I42SR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaacgctagaagatgctgctaacttatactgtcatcagagtactactttacctctaagtgatctaccttcggaccaagggacacgtacgtggaagtaagttaaacgaacgtgttacggctacggacctaccgtattccttgtccttacg

SEQ ID NO: 171701 - DNA, 495 bp, Homo sapiens
  misc_feature: GYAE6OF02IU2NX.27.78.H01.1.454.CMB.1.raw
  modified_base (387)..(387): a, c, t, g, unknown or other
  misc_feature (387)..(387): n is a, c, g, or t
  modified_base (428)..(428): a, c, t, g, unknown or other
  misc_feature (428)..(428): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagctggagctgaagntgctgcaacttattactgtacatcagagtactactttaccncaagtgatctaccttcggaccaagggacacgactaggagaattaacgatgtgctgcacatctgtctc

SEQ ID NO: 171702 - DNA, 510 bp, Homo sapiens
  misc_feature: GYAE6OF02F0CXM.27.78.H01.1.454.CMB.1.raw
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaagctagaagatgctgactaacttattactgtcatcagtagtacttactttaccnctaagtgatcaccttcgaccaagggacacgactggagtaacttaaacgactgtgctgccaccatctgtcttac

SEQ ID NO: 171703 - DNA, 513 bp, Homo sapiens
  misc_feature: GYAE6OF02HJ43M.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaanctgaagatgctgctaacttattactgtcatcagagtacttactttacctctaagtgatcaccttcggaccaaagggaccacgactaggagtaattaaacgactgtggctgaccacctatctgtcttac

SEQ ID NO: 171704 - DNA, 492 bp, Homo sapiens
  misc_feature: GYAE6OF02HA4BO.27.78.H01.1.454.CMB.1.raw
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgcaacttattactgtcatcagatactactttaccncaagtnatcaccttcggcaagggcacgactggagaattaacgactgtgctgcaccatctgtctc

SEQ ID NO: 171705 - DNA, 504 bp, Homo sapiens
  misc_feature: GYAE6OF02F1HUW.27.78.H01.1.454.CMB.1.raw
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctnacccatcaatgcctggaagctgaagatgctgcaacttattactgtcatcagtatactactttacncaagttnatcaccttcggccaagggaccacgtactggaagattaaacgaactgtaggctgcaccatctgtcttac

SEQ ID NO: 171706 - DNA, 498 bp, Homo sapiens
  misc_feature: GYAE6OF02H1DWM.27.78.H01.1.454.CMB.1.raw
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacgatttcacccttcaccatcaatagcctggaanctgaagatgctgcaacttattactgtcatcagagttactactttacctnaagtgactcaccttcgccaagggcacgactgganattaacgacttgngctgcacntctgtc

SEQ ID NO: 171707 - DNA, 497 bp, Homo sapiens
  misc_feature: GYAE6OF02GL4D4.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctctaagtgatcaccttcggaccaagggacacgactggagattaaacgactgtcgatgcacatctgtctc

SEQ ID NO: 171708 - DNA, 493 bp, Homo sapiens
  misc_feature: GYAE6OF02GFKYS.27.78.H01.1.454.CMB.1.raw
  modified_base (488)..(488): a, c, t, g, unknown or other
  misc_feature (488)..(488): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggcacgactggagataacgactgtgctgcacatctntctac

SEQ ID NO: 171709 - DNA, 507 bp, Homo sapiens
  misc_feature: GYAE6OF02IABKK.27.78.H01.1.454.CMB.1.raw
  modified_base (388)..(388): a, c, t, g, unknown or other
  misc_feature (388)..(388): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaanctagaagatgctgactaacttattactgtcatcagagtactactttaccnctaagtnatcaccttcggaccaaggacacgactggaagattaaacgacttgagctagccaccatctgtc

SEQ ID NO: 171710 - DNA, 498 bp, Homo sapiens
  misc_feature: GYAE6OF02HTI7S.27.78.H01.1.454.CMB.1.raw
  modified_base (430)..(430): a, c, t, g, unknown or other
  misc_feature (430)..(430): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgctaacttattactgtcatcagatactacttacctnaagtgatcaccttcggccaaggacacgactggagtattaaacgactgtaggntgcaccatctgtcttc

SEQ ID NO: 171711 - DNA, 510 bp, Homo sapiens
  misc_feature: GYAE6OF02HO4SU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggagtagcttacactggtaccagcagaagccaggtcagtctccaaagctcctcatcaagtatgcttcccagtccttctcacgggtcccctgaggttcagtggcagtggatctggacacatttcaccctcaccatcaatacgcctaggaacgctagaaagatgctgctaacttatactgtcatcagatacttactttacctcaagtgatcacccttcggaccaaagggaccacgactaggagaattaaacgaactgtacgctgcaccatctgtcttac

SEQ ID NO: 171712 - DNA, 505 bp, Homo sapiens
  misc_feature: GYAE6OF02IHGXU.27.78.H01.1.454.CMB.1.raw
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcacggggtcccctgaggttcagtcggcagtggatcgtgggacactatttccaccctcaaccatacaatacgcctaggaagctagaaagatgctgactaacttattactgtcatcagatactactttaccnaatgatcacttcggacaaggacagactggagaattaaacgatgtcgctgcaccatctgtctc

SEQ ID NO: 171713 - DNA, 509 bp, Homo sapiens
  misc_feature: GYAE6OF02FY77P.27.78.H01.1.454.CMB.1.raw
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcggttggtagtagcttacactggtaccagcagaagccaggtcagtctccaaagctcctcatcaagtatgcttcccagtccttctcagggtcccctcgaggttcagtggcagtggatcgtggacacatttcaccctcaccatcaatagcctggaagctgaagatgctgcaacttattactgtcatcagtatacttactttacctactaagtnatcaccttcggacctaagggaccacgactggagtaagttaaacgactggtcgctcgcaccatctgtcttc

SEQ ID NO: 171714 - DNA, 520 bp, Homo sapiens
  misc_feature: GYAE6OF02ICAG5.27.78.H01.1.454.CMB.1.raw
  modified_base (341)..(341): a, c, t, g, unknown or other
  misc_feature (341)..(341): n is a, c, g, or t
  modified_base (422)..(422): a, c, t, g, unknown or other
  misc_feature (422)..(422): n is a, c, g, or t
  modified_base (475)..(475): a, c, t, g, unknown or other
  misc_feature (475)..(475): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagagccaggtcagtctccaagctcctcatcaagtatgcttcccagtccttcncgacgggtccctgaggttcagtgcagtgatcgtggacactactttccaccctcaccatcaatcgcctaggaagctagaagntgctgactaacttattactgtacatcaagagttaacttacttacctactagtnatcctaccttcggaccaagggacacgtacgtaggacgattaaacg

SEQ ID NO: 171715 - DNA, 510 bp, Homo sapiens
  misc_feature: GYAE6OF02IWRSA.27.78.H01.1.454.CMB.1.raw
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacactatttcaccctcaccatcaatagcctggaagctgaagatgctgcaacttattactgtcatcagagtactactttacctnaagtgatctaccttcggaccaagggacacgactggagtaattaaacgaactgtggctggaccaccattctgtcc

SEQ ID NO: 171716 - DNA, 509 bp, Homo sapiens
  misc_feature: GYAE6OF02IFMPN.27.78.H01.1.454.CMB.1.raw
  modified_base (196)..(196): a, c, t, g, unknown or other
  misc_feature (196)..(196): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctccaaagctcctcatcaagtatgctcccagtccttctcagggtcccctgaggttcagtggcagtggatctgggcacgatttccaccctcacccatcaatacgcctaggaagtctgaagatgctgctaattattactgtcatcagatactactttacctacagtntatctaccttcggacaaggacacgactggagaattaaacgactgtcggctcgacaccactctcgtacttaccg

SEQ ID NO: 171717 - DNA, 506 bp, Homo sapiens
  misc_feature: GYAE6OF02I252X.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctagaagatgctgcaactttatactgtcatcagagtactactttactctaagtgatcaccttcggaccaaggacacgactggaagattaaacgaactgtaggctgaccaccatccgtgtcc

SEQ ID NO: 171718 - DNA, 574 bp, Homo sapiens
  misc_feature: GYAE6OF02JV906.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgacggttcaggtggcagtggatcgtgggacactactttccacccttcaccatccaatacgcctggaacgctagaagtatgctgactaacttattactgtacatcagtacgttacttactttaccacgtaagtcgtactcctaccgttacggaccgtaaggggaccacggtacgtacgggaacgtaacttaaaccggaacttcggtacggccgttacggacctaccgtacttcccgttaggttaccc

SEQ ID NO: 171719 - DNA, 540 bp, Homo sapiens
  misc_feature: GYAE6OF02GD5D1.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgacggggtcccctcgacggttcagtggcagtggatcgtgggacacgatttccaccctcaaccatcaatacgcctggaagctagaagatgctgactaacttattactgtcatcagacttactacctttacctctaagtgattcaccttcggacctaaacgggacacgacgtaggaagtaattaaaccgaacgtggtaggcgtacgcctaccattcctagttccttacg

SEQ ID NO: 171720 - DNA, 535 bp, Homo sapiens
  misc_feature: GYAE6OF02I3HGK.27.78.H01.1.454.CMB.1.raw
  modified_base (332)..(332): a, c, t, g, unknown or other
  misc_feature (332)..(332): n is a, c, g, or t
  modified_base (449)..(449): a, c, t, g, unknown or other
  misc_feature (449)..(449): n is a, c, g, or t
  modified_base (528)..(528): a, c, t, g, unknown or other
  misc_feature (528)..(528): n is a, c, g, or t
tcagagcgtcgtctcacgaccggtgctcgatttagtgtgagtagtttggggtttgggggcatgagcaaaactgacaagtcaaggcaggaagatgttcgccatcacaactcattgggtttctgctgctctgggttccagcctccaggggtgaaattgtgctgactcagtcctccagactttcagtctgtgactccaaaggagaaagtcaccatcacctgccgggccagtcagagtcgttggtagtagcttacactggtaccagcagaagccaggtcagtctccaaagctccgtcatcaagtactgcttcccagtccttctcgaggggtccccngtaggttccagtgcaggtgatctagggacacatttccacctcaccgatcaaagtcgcctggaagctagaagctagcctgacaaatttatactgtcatcagacgttactactttaccnaacgtgactctaccgttcggaccaagggtaccacgtacgtaggataaacgttaacgaacttggagcaggaccacgcttntcgttac

SEQ ID NO: 171721 - DNA, 510 bp, Homo sapiens
  misc_feature: GYAE6OF02H6AZ8.27.78.H01.1.454.CMB.1.raw
  modified_base (196)..(196): a, c, t, g, unknown or other
  misc_feature (196)..(196): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggngaaagtcaccatcacctgccgggccagtcagagcgttggagtagcttacactggtaccagcagaagccaggtcagtctccaaagctcctcatcaagtatgcttcccagtccttctcaggggtcccctcgaggttcagtggcagtggatctgggacacatttccaccctcaccatcaatcgacctggaagctagaagatgctcgactaactttattactgtcatcaagagtactactttacctnaagtgatccaccttcggacaacgggacacgactggagattaaacgactgtagctcgacaccatctgtcttc

SEQ ID NO: 171722 - DNA, 521 bp, Homo sapiens
  misc_feature: GYAE6OF02GYXQ8.27.78.H01.1.454.CMB.1.raw
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtccctcgaggttcagtggcagtggatctggacacactttcaccctcaccatcaatagcctggaanctagaanatgctgcaacttnttactgtcatcagtagtacttactttaccataagtnactcaccttcggaccaagggaccacgtactggagtaacgttaaacgacgttgtaggacctagcctaaccagtcctcgtacttac

SEQ ID NO: 171723 - DNA, 506 bp, Homo sapiens
  misc_feature: GYAE6OF02I9OKU.27.78.H01.1.454.CMB.1.raw
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatacgctggaagctagaagatgctgacctaacttattactgtcatcagtactacttactttaccnctaagtcatcctaccttcggaccaagggacacgactgganataaacgatgtagctgcaccntctgtctc

SEQ ID NO: 171724 - DNA, 507 bp, Homo sapiens
  misc_feature: GYAE6OF02FIPWW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagtagtactactttacctcaagtgatcaccttcggaccaagggaccacggactggagaattaacgaactgtacggctgccactatctgtcttac

SEQ ID NO: 171725 - DNA, 497 bp, Homo sapiens
  misc_feature: GYAE6OF02H2Z8S.27.78.H01.1.454.CMB.1.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatcgtggacacatttcaccctcaccatcaatagcctggaagctgaagatgctgcaacttattactgtcatcagagtactactttaccnctaagtnatcaccttcggaccaagggcacgactggagaattaaacgactgtgctgcaccatctgtctc

SEQ ID NO: 171726 - DNA, 502 bp, Homo sapiens
  misc_feature: GYAE6OF02ISWKO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtccccctgaggttcagtggcagtggatctgggacacatttcaccctcaccatcaatacgcctgaacgctagaagatgctgacaacttattactgtcatcagtatacttacttacctacaagtgatcacctttcggccaaaggcacgactggagattaaacgacgtgtgctgaccacatctgtcttac

SEQ ID NO: 171727 - DNA, 541 bp, Homo sapiens
  misc_feature: GYAE6OF02IXSR5.27.78.H01.1.454.CMB.1.raw
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtccctcgaggttcagtggcagtggatcgtgggacacatttcaccctcaccatcaatacgcctggaacgctagaagatcgctgctaacttattactgtcatcaagagttactactttacctactaagtnactcctacccgtttacggacctaacgggaccaacggtaccgtaggacgtaagttaaaaccgg

SEQ ID NO: 171728 - DNA, 586 bp, Homo sapiens
  misc_feature: GYAE6OF02G9ZUQ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagctcctacatcaagtatcgaccttcccagttcccttctccgacgggggttcccctcggtaggtttccaggttggctaggtggatcgtgggacactactttccaccctcaccatacaaatacgcctaggaacgtctaggaacgatcgctagactaactttattactgtacatcgaagtacgttaacttactttacctagtaacgtcgtaactacctaaccgttaccggaaccgtaacgggaccaacggtacgtagggaacgtaagttaaaaccgg

SEQ ID NO: 171729 - DNA, 524 bp, Homo sapiens
  misc_feature: GYAE6OF02HPKFO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatacgcctggaacgctagaagatgctgctaacttattaactgtccattcaagtagttactactttacctcaagtgatcaaccttcggaccaaagggacacgactggaacgtaattaaacgaactgtcggactggaccaccattcgtagtcttacg

SEQ ID NO: 171730 - DNA, 498 bp, Homo sapiens
  misc_feature: GYAE6OF02IM7LO.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtacatcagagtactactttacctcaagtgatcaccttcgccaaaggcacgactggagattaaacgaactgtgactgcaccatctgtcttac

SEQ ID NO: 171731 - DNA, 511 bp, Homo sapiens
  misc_feature: GYAE6OF02JIDQL.27.78.H01.1.454.CMB.1.raw
  modified_base (381)..(381): a, c, t, g, unknown or other
  misc_feature (381)..(381): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtgatctggacacatttcaccctcaccatcaatgcctggaacnctagaagatgctgactaacttattactgtcatcagtatacttactttaccncaagtnatcaccttcggaccaagggacacgactaggataacttaaacgactgtcggctgaccacctatcttcgtcttac

SEQ ID NO: 171732 - DNA, 548 bp, Homo sapiens
  misc_feature: GYAE6OF02HA779.27.78.H01.1.454.CMB.1.raw
  modified_base (327)..(327): a, c, t, g, unknown or other
  misc_feature (327)..(327): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccgggccgtcagagcgttggtagtagcttacactggtaccagcagaagccaggtcagtctccaaagctcctcatcaagtntgcttcccagtccttctcgacgggtcccctgaggttcagtggctagtggatcgtgggacactactttccacccctcacccatccaaatacgcctaggaacgctagaagtatgctcgactaacttattactgtcatcagtacgtaacttacctttacctataagtcgactccaccgttccggacccaagggtaccacgacgtcggaagtacgttaacgtacg

SEQ ID NO: 171733 - DNA, 495 bp, Homo sapiens
  misc_feature: GYAE6OF02INME7.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatgcctggaagctgaaagatgctgactaacttattactgtcatcagatactacttacctanaagtgatcaccttcggaccaagggcagactggagaattaaacgatgtgctgcaccatctgtctc

SEQ ID NO: 171734 - DNA, 533 bp, Homo sapiens
  misc_feature: GYAE6OF02G3GNO.27.78.H01.1.454.CMB.1.raw
  modified_base (429)..(429): a, c, t, g, unknown or other
  misc_feature (429)..(429): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcacctcaccatcaatagcctgaagctagaagatgctgactaacttattactgtcatcagtatactacttacnctaagtgatctaccttcggaccaagggaccacgtacgtgggaagtaacttaaaccgaacgttggtacggtactacggtacctaccgtacgtacttcgtcttacc

SEQ ID NO: 171735 - DNA, 683 bp, Homo sapiens
  misc_feature: GYAE6OF02J3NKN.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccgagggtgaattgtgctgactcagtctccagtactttcagtctgtcgactaccaaagganaacgtcaccatccaccgtgccgggcagtcagtagtcgttggtagtacgcttacgactacggtaccagacaagacgccaggtcacgtactaccaaagcctcctacactacaagttactcgtccttcccgacgttccttcgtccggtaccgggttccctacggtacggttcgtaggttcggacaggttcgacgttcgacgggtaacctactactttacccaaccctacaacctaactactaacgtacgaccggttaggaacgtcgtagaacgtactcgtacgtacgtactaacttacttacgtctacctaagtacctaacgttaccgtttaaccttacgtttaaccagttaacggtactaaccgttaccgtaaccgggttaccgaaccgggaacgtaccgtaacggtacgtaacggtaacgttaaaccgttaacgaacggttcggtacgtctaccgacctaccgtacttccgttacgtaccttacccg

SEQ ID NO: 171736 - DNA, 495 bp, Homo sapiens
  misc_feature: GYAE6OF02GQDQD.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaagctgaagatgctgcaacttattactgtcatcagagtactactttacctacaagtgatcaccttcggcaagggacacgactggagaattaacgactgtgctgcaccatctgtcttc

SEQ ID NO: 171737 - DNA, 501 bp, Homo sapiens
  misc_feature: GYAE6OF02GAON6.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgacaacttattactgtcatcagagtacctactttacctcaagtgatcaccttcggccaagggaccacgactggagaattaaacgactgtggctgcaccatctgtctc

SEQ ID NO: 171738 - DNA, 679 bp, Homo sapiens
  misc_feature: GYAE6OF02GX728.27.78.H01.1.454.CMB.1.raw
  modified_base (441)..(441): a, c, t, g, unknown or other
  misc_feature (441)..(441): n is a, c, g, or t
  modified_base (520)..(520): a, c, t, g, unknown or other
  misc_feature (520)..(520): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccagggtgaatagtgctgactacagtctccacgatttctagctgtgactaccaaacggaaagaaagtacaccatcaacctgccggccgactacgagaagcgttggttaggtaagcttacctaacgcgggtacctacgacgacgaaagacgacggtacgacgtctacaaacgacgtcctactacataacggtaatcggtcttcccctacgaccttttccttcgacggggttaccccgtcccgttaacggtgtacgtgggtccgaagcgggtagtctacggaccgtaactactttcgtaaccccncctaacccaagttacaacgtaaacgctacggaaagtctagtaacgagttaacgctcggtacaaaccttaagtttaaccngtttaacgtactactaacgaacgttaacttaaccttttaacctaccttaaaggacttacgacttaccgtacccgtacgaaccgtaacggaacctacgttaaggaccgtaaaggtaaacctaaacgtaaggcgtcgaacgtcaaccactctacgttctac

SEQ ID NO: 171739 - DNA, 495 bp, Homo sapiens
  misc_feature: GYAE6OF02ILNEQ.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaagctagaagatgctgcaacttattactgtcatcagactactacttacctcaagtgatcaccttcggccaaggacacgactggagattaaacgactgtcgctgcacgatctgtcttac

SEQ ID NO: 171740 - DNA, 507 bp, Homo sapiens
  misc_feature: GYAE6OF02GYVKN.27.78.H01.1.454.CMB.1.raw
  modified_base (437)..(437): a, c, t, g, unknown or other
  misc_feature (437)..(437): n is a, c, g, or t
  modified_base (503)..(503): a, c, t, g, unknown or other
  misc_feature (503)..(503): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgacggttcagtggcagtggatctggacacatttcaccctcaccatcaatagcctggaagctagaagatgctgacaacttattactgtcatcagtatactactttactcaagtnatacaccttcggccaagggcacgactaggagtaattaaacgactgtcggatcgcaccgatctcgtnttac

SEQ ID NO: 171741 - DNA, 562 bp, Homo sapiens
  misc_feature: GYAE6OF02GY3ZD.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgacgttcagtgcagtgatctggacacattcaccctcaccatcaatagcctaggaagctagaagatgctgactaacttattactgtacatcagtacgttacttactttacctactaagtcgtactacctaccgttcggaccgtaacgggaccacggtacgtacgggaagtaacgtttaaaccggaacgttaggtacgggaccttacggacctaacccgtacttaccgttagttaccc

SEQ ID NO: 171742 - DNA, 509 bp, Homo sapiens
  misc_feature: GYAE6OF02I0LXE.27.78.H01.1.454.CMB.1.raw
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgcagctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctcgaggttcagtgcagtggatcgtgggacacatttcaccctcaccatcaatagcctggaagctagaagatgctgactaacttattactgtcatcagagtactacttactctaagtnactcaccttcggaccaagggacacgactggatataaacg

SEQ ID NO: 171743 - DNA, 508 bp, Homo sapiens
  misc_feature: GYAE6OF02GJ8VH.27.78.H01.1.454.CMB.1.raw
  modified_base (229)..(229): a, c, t, g, unknown or other
  misc_feature (229)..(229): n is a, c, g, or t
  modified_base (464)..(464): a, c, t, g, unknown or other
  misc_feature (464)..(464): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcacggggtccctcgaggttcagtggcagtggatcgtgggacacatttcaccctcaccatcaatagcctggaacgctgaagatgctgcaacttatactgtcatcagagtactactttaccnaagtgatcaccttcggaccaagggacacgactggagattaaacg

SEQ ID NO: 171744 - DNA, 522 bp, Homo sapiens
  misc_feature: GYAE6OF02JEUEL.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccaacagaagccaggtcagtctccaaagctcctcatcaagtatgcttcccagtccttctcgacggggtcccctcgaggttcagtcggcagtggatcgtgggacacatttccaccctcaccatcaatagcctggaagctagaagatgctgacaacttattactgtacatcagtagtactactttacctcaagtgactcaccttcggaccaagggacacgactggaatacttaagtacg

SEQ ID NO: 171745 - DNA, 494 bp, Homo sapiens
  misc_feature: GYAE6OF02FOMBS.27.78.H01.1.454.CMB.1.raw
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
  modified_base (480)..(480): a, c, t, g, unknown or other
  misc_feature (480)..(480): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatccaatacgcctggaagctgaagatgctgcaacttattacngtcatcagagtactactttacctcaagtnatcaccttcggcaagggcacgactgganattaaacgatgngctgcacatctgtc

SEQ ID NO: 171746 - DNA, 494 bp, Homo sapiens
  misc_feature: GYAE6OF02GKN9Y.27.78.H01.1.454.CMB.1.raw
  modified_base (431)..(431): a, c, t, g, unknown or other
  misc_feature (431)..(431): n is a, c, g, or t
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctnaagtgatcaccttcggaccaaggcacgactggagattaacgactgtgntgcaccatctgtctc

SEQ ID NO: 171747 - DNA, 499 bp, Homo sapiens
  misc_feature: GYAE6OF02GAWT1.27.78.H01.1.454.CMB.1.raw
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (491)..(491): a, c, t, g, unknown or other
  misc_feature (491)..(491): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatatgggacacatttccaccctcaccatcaatagcctggaagctgaagatgctgcaacttattactgtcatcagagtactactttaccncaagtnatcaccttcggccaagggacacgactggagtataaacgactgtagctgcacctanctgtcttc

SEQ ID NO: 171748 - DNA, 550 bp, Homo sapiens
  misc_feature: GYAE6OF02IR2WB.27.78.H01.1.454.CMB.1.raw
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (457)..(457): a, c, t, g, unknown or other
  misc_feature (457)..(457): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcggaggttcagtcggctagtggatctgggacactatttccaccctnaaccatcaatagcctagggaaanctagaagatgctgactaaaccttattactgttacatcaagtacgttaccttattttaacccncaagtgtatccaccttcggaccaagggaccacgacgtggaagtacgttaaacgaaccttggacggcttacggacctaacctattcctagttcc

SEQ ID NO: 171749 - DNA, 593 bp, Homo sapiens
  misc_feature: GYAE6OF02IY8JL.27.78.H01.1.454.CMB.1.raw
  modified_base (347)..(347): a, c, t, g, unknown or other
  misc_feature (347)..(347): n is a, c, g, or t
  modified_base (440)..(440): a, c, t, g, unknown or other
  misc_feature (440)..(440): n is a, c, g, or t
tcagagcgtcgtctcacgaccggtgctcgatttagtgtgagtagtttgggtttggggaggtgagcaaaaactgacaagtcaaggcgaggaagatgttgccatcgacaactcattgggtttcctgcctgctctgggttccagcctccgaggggtgaaacttgtgctgactcagtctccagactttcagtctggtgactccaaaggagaaagtcaccatcacctgccgggccagtcagagcgttggtagtagcttacactggtaccagcagaagccaggtccagtctccaagcctcctcatcaagtatgcttccagtccttctccgagggtcccctgagttcagtgcgngtgatcgtggacactattccgaccctcaccactactaactacgccgtaggaactccgtaggaagagtcgctgacttaacttattactgtcatnaagtacgtacttaactttaccacgttaaggtgtacgtccgtaccgttccggaccgtaaacgggaccaaccggtacgtagggaacgtaacgttaaaccggacgttaggtaccggtacctacgcctaaccctcgttaccttccgttccttacccg

SEQ ID NO: 171750 - DNA, 490 bp, Homo sapiens
  misc_feature: GYAE6OF02FMF18.27.78.H01.1.454.CMB.1.raw
  modified_base (195)..(195): a, c, t, g, unknown or other
  misc_feature (195)..(195): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcagggtccctcgaggttcagtggcagtggatctggacacatttcaccctcaccatcaatagcctggaagctgaagntgctgcaacttattactntcatcagatactacttacctnaagtnatcaccttcggaccaaggacacgactggagattaacgactgngctgcaccatctgtctc

SEQ ID NO: 171751 - DNA, 537 bp, Homo sapiens
  misc_feature: GYAE6OF02FV4ZI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagttccttctcacggggtcccctcggtacggttcagtgctaggtggatcgtgggacacatttccaccctcaccatcaatacgcctggaacgctagaagatgctgactaacttacttactgtcatcagtacttactactttacctatagtgtactcctaccgttacggaccgaacggaccacgacgtaggacgtattaaacgg

SEQ ID NO: 171752 - DNA, 524 bp, Homo sapiens
  misc_feature: GYAE6OF02JGX5Q.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacaatcaatagcctggaanctagaagatgctagctaacttattactgtcatcagagtacttactttacctctaagtgaattccgaccttcggaccaagggacacgacgtacggaagtaattaaacggaacttgtaggctggacctaccattcttgtcc

SEQ ID NO: 171753 - DNA, 505 bp, Homo sapiens
  misc_feature: GYAE6OF02HXMLR.27.78.H01.1.454.CMB.1.raw
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcccttctcacggggtcccctgaggttcagtggcagtggatctgggacacatttcaccctcaccatcaatacgctagaagctgaagatgctgactaacttatactgtcatcagagtactactttactacagtnatcaccttcgaccaggacacgacaggagaataacg

SEQ ID NO: 171754 - DNA, 549 bp, Homo sapiens
  misc_feature: GYAE6OF02IND4W.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctagaagatgctagacaacttattactgtacatcaagtacgtacttactttacctactaagtgaacttccaacccgtttcggacccaaagggacctaacgacgtggaagaacttaaaaccgaacgttcgtacggctagaccaacctagtacctcgttaccttacg

SEQ ID NO: 171755 - DNA, 526 bp, Homo sapiens
  misc_feature: GYAE6OF02H17KX.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcagggtcccctcgaggttcagtggcagtggatctgggacacatttcaccctcaccatcaatagcctggaagctagaagatgtctgactaacttattactgtacatacagtacgtaacttactttacctactaagtatactacctaccgttccggacgaacgggacaacgacgtaggagtaaataaacgagtgtagctcgacacctatctcgtctac

SEQ ID NO: 171756 - DNA, 835 bp, Homo sapiens
  misc_feature: GYAE6OF02HYV56.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcaacaactcattgggtttctgctgctcgtgggttccagcctccgaggggtagtaaattgtgctgactcagtctccagtactttcagtctgtgactaccaaaaggaagaaagtcaaccatcacctggcccgggccagtcagagcgttggtagtagcttaacactggtaccagcagaagccaggtcagtctaccaaagcctccctcatcaagtatcgtccttccctacgtcccttctccgacggggttccccctcggtacggtttcgaggttcggacgtaggtaggacgttcggtacggggaaccaacgttacttttacccaacccccttaccaaccctaacttaccaaattaaccggacccgttaacgggaaacggtcgtttaacggaaaaggtacgttacggtaccgttacggtaaaccttaaaacccgtttttaactttaacccgtttaggttaaccctaaacgtttaccgtaaaacgggttaaaccgttttaacccttttaaaccccgttttttaaccccgttaaccgttaaaacgggtttccggttaaacccgttttaaccccgttaaacccccggttttaaccccggggtaaacccccgggtaaaaccggggggtaaaccccgttaaacccccggggttaaaccgggtttaaccggggtaaacggggttaaaaaacccgttttaaaaaaaccccggggg

SEQ ID NO: 171757 - DNA, 547 bp, Homo sapiens
  misc_feature: GYAE6OF02HZILQ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaaccatcacctgccgggcagtcagagcgttggtagtagcttacactggtaccagcagaagccaggtcagtctccaaagctcctcatcaagtatgccttccagtccttctcacggggtccctcgaggttcagtgcagtggatcgtgggacactactttcaccctcaccatacaaatacgccttaggaaacgcttagaaagtatgctgacctaaactttattactcgttacattacagaacgttactaccttttaccactaagtgactactaccgttacggccaagggaccacgtactaggagtaattaaacgg

SEQ ID NO: 171758 - DNA, 533 bp, Homo sapiens
  misc_feature: GYAE6OF02I2X9V.27.78.H01.1.454.CMB.1.raw
  modified_base (384)..(384): a, c, t, g, unknown or other
  misc_feature (384)..(384): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttgtagtagcttacactggtaccagcagaagccaggtcagtctccaaagctcctcatcaagtatgcttcccagtccttctcaggggtcccctgacgttcagtggcagtggatctggggacacattcaccctcaccatcaatacgcctaggaanctagaagatgcctagctaacttattacctgtacatacagtaagtactaacttactacaagtagatcctaccttcggaccgaacgggactacgacctaggacgtaattaaaccgaatggtagctaggactaaccattacgtcgttcttac

SEQ ID NO: 171759 - DNA, 499 bp, Homo sapiens
  misc_feature: GYAE6OF02FZYTI.27.78.H01.1.454.CMB.1.raw
  modified_base (195)..(195): a, c, t, g, unknown or other
  misc_feature (195)..(195): n is a, c, g, or t
  modified_base (496)..(496): a, c, t, g, unknown or other
  misc_feature (496)..(496): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatacttcccagtccttctcacggggtcccctcgaggttcagtggcagtggatctgggacacatttcaccctcaccatcaatagcctggaagctgaagatgctgctaacttatactgtcatcagagtactactttacctcaagtgatcaccttcggccaagggacacgactggagattaaacgactgtgctgcacatctgtctntac

SEQ ID NO: 171760 - DNA, 515 bp, Homo sapiens
  misc_feature: GYAE6OF02F38OW.27.78.H01.1.454.CMB.1.raw
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctagaagatgctgacaacttattactgtcatcagtatacttactttaccnaagtgatctaccttcggaccaagggaccacgacgtaggagtaacttaaacgaacgtgtaggctcgcaccatctgtccttac

SEQ ID NO: 171761 - DNA, 505 bp, Homo sapiens
  misc_feature: GYAE6OF02F025T.27.78.H01.1.454.CMB.1.raw
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacggggtcccctcgaggttcagtggcagtggatcgtgggacactatttcaccctcaccatcaatacgcctaggaanctagaagatgctgctaacttattactgtcatcagatacttactttaccanagtgatcaccttcgaccaagggacacgactggagtaattaaacgatgtgctgacaccatctgtctc

SEQ ID NO: 171762 - DNA, 510 bp, Homo sapiens
  misc_feature: GYAE6OF02GY5OC.27.78.H01.1.454.CMB.1.raw
  modified_base (386)..(386): a, c, t, g, unknown or other
  misc_feature (386)..(386): n is a, c, g, or t
  modified_base (441)..(441): a, c, t, g, unknown or other
  misc_feature (441)..(441): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctagganctgaagatgctgcaacttattactgtcatcagattactactttacctctaagttnactcaccgttcggaccgaagggaccacgactaggagaattaacgaactgtggctgccactntctnttcc

SEQ ID NO: 171763 - DNA, 501 bp, Homo sapiens
  misc_feature: GYAE6OF02F94LK.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactggaagattaaacgaactgtggctgccaccatctgtcc

SEQ ID NO: 171764 - DNA, 517 bp, Homo sapiens
  misc_feature: GYAE6OF02JEDCT.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcaggggtcccctgaggttcagtcgcagtggatctgggacactatttcaccctcaaccatcaactagcctaggaagctagaagatgactgctaacttatactgtacatccagagtactacttactctaagtgatcaccttaccgacgaacggacacgactacggacattaaacg

SEQ ID NO: 171765 - DNA, 498 bp, Homo sapiens
  misc_feature: GYAE6OF02G4IUQ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggaccaagggacacgactggaagattaaacgactgtgctgctaccatctgtctc

SEQ ID NO: 171766 - DNA, 763 bp, Homo sapiens
  misc_feature: GYAE6OF02IU1GZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcccctacgggtgggtaataagttggtcgtcgtacgtcctacgtacgttccctacgaacgttttaccttacgtacgttcgttggtacgtaccctaaacggaaagggaaaggtaacgtacccaactactaccctacgtccgggcccggacgtacgtacgaaggacggttcgggttaggtaagtaccgttactaaccgtacggttaccgaacgacgacgaaaggaccgacggtacgtacgtacgttccaaacgaacgtcccttccaatactaacgtaagttcgtccgttccccttaccgtacctttccttccgacgggggtaccccggttcccctagggttacgtacgtagggtcgacgtgggtagtactgggtacgaactacgtttctacccacctaccaactactaactacgtcctcggaaggacctgtaagaagtgctgactaacttaattactgttcactactagaagttaccttactttaaccttcaagtagtactactacccgttaccggtaccgaaacggaacgaccgtaaccgtagggtaaggtaacttaaaaccggttaaacggtcgttcgggtacgttaccgtacaaccctaacgttcttcggtttacccgttcttaacccg

SEQ ID NO: 171767 - DNA, 547 bp, Homo sapiens
  misc_feature: GYAE6OF02F37H9.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctaggaacgctagaagatgctgctaacttattactgtcatcagtagtactactttacctactaagttgacttccaccgtttcggacctaaagggaccacggtactagggaagtaacttaaaccggaacttaggtaggccttacggacctaaccatccttcgttccttacg

SEQ ID NO: 171768 - DNA, 500 bp, Homo sapiens
  misc_feature: GYAE6OF02I3X39.27.78.H01.1.454.CMB.1.raw
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtgcagtggatctgggacactatttcaccctcaccatcaatacgcctaggaagctgaaagntgctgacaacttattactgtcatcagagtactactttactacaatgactcaccttcgccaaggcacgactggaagattaacgactgtcgactggcaccatctgtcttac

SEQ ID NO: 171769 - DNA, 529 bp, Homo sapiens
  misc_feature: GYAE6OF02JIEKY.27.78.H01.1.454.CMB.1.raw
  modified_base (449)..(449): a, c, t, g, unknown or other
  misc_feature (449)..(449): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagcaggtcagtctcaaagctcctcatcaagtatgcttcccagtccttctcgacgggtcccctcgacggttcagtggcagtggatcgtgggacacatttccaccctcaccatcaatacgcctaggaagctagaagatgctgactaacttattactgtacatcagtagtacttaactttacctactaagtnactcctaccttcggaccgaaggacacgataggaagtaactaaacgactgtacgcgtacgacacctatccgttagtcttac

SEQ ID NO: 171770 - DNA, 508 bp, Homo sapiens
  misc_feature: GYAE6OF02H17CC.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggttaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttccagtcctctcagggtcccctcgaggttcagtggcagtggatctgggacacgtatttcacccctcaccatcaatagcctggaagctagaagatgctgcaacttattactgtcatcagatactactttacctcaagtgtatcaccttcgccaaggcacgactggagtattaacgtacg

SEQ ID NO: 171771 - DNA, 508 bp, Homo sapiens
  misc_feature: GYAE6OF02GZ1V9.27.78.H01.1.454.CMB.1.raw
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacggggtcccctcgaggttcagtggcaggtggatcgtgggacacatttcaccctcaccatccaatacgcctggaagctagaagatgctgactaacttnttactgtcatcagtagtacttacttacctcaagtgactcaccttcggaccaagggcacgactggagtaattaacgactgtgctgcaccntctgtc

SEQ ID NO: 171772 - DNA, 499 bp, Homo sapiens
  misc_feature: GYAE6OF02GT483.27.78.H01.1.454.CMB.1.raw
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatacgcctggaagctgaagatgctgcaacttatactgtcatcagagtactactttacctnagtnatcaccttcggccaagggacacgactggagaacttaaacgactgtagctgacacatctgtcttac

SEQ ID NO: 171773 - DNA, 606 bp, Homo sapiens
  misc_feature: GYAE6OF02JZYUQ.27.78.H01.1.454.CMB.1.raw
  modified_base (393)..(393): a, c, t, g, unknown or other
  misc_feature (393)..(393): n is a, c, g, or t
  modified_base (558)..(558): a, c, t, g, unknown or other
  misc_feature (558)..(558): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgtcttcccagtccttctcacggggtcccctcgacggttccagtggcaggtggatcgtgggaccactactttccaccctcacctatcaatcgcctaggaanctagaagatgctagtactaacttatactgtacatcgaagtacgtactttaccttacctacgtaacgtgtaacttccgtaaccgtttccggaccgaaacggggtaccaaccggtacgtacgggaacggttaaacgttaaaacccggagttaccggtacggtaaccncgggttaacccaacccgtgtttacccggtttacggttaccctttaccc

SEQ ID NO: 171774 - DNA, 509 bp, Homo sapiens
  misc_feature: GYAE6OF02I576D.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctagaagatgctgactaacttattactgtcatcagagtaacttactttacctacaagttgattccaccttccggacaagggacacgactggaagtattaaacgaactgtgctgccacatctgtcttc

SEQ ID NO: 171775 - DNA, 556 bp, Homo sapiens
  misc_feature: GYAE6OF02GZ3S5.27.78.H01.1.454.CMB.1.raw
  modified_base (448)..(448): a, c, t, g, unknown or other
  misc_feature (448)..(448): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacgggtcccctcgaggttcagtgcagtggatcgtggacacatttccaccctcaccatcaatagcctggaagctagaagatgctgactaacttattactgtcatacagtactacttaactttacctactaagtnacttcctacccgttcggacctaaagggaccaacggtactacggaagtaacttaaaccggaacgtggtacggtctacggacctaaccgtactacgttacgttccttacg

SEQ ID NO: 171776 - DNA, 548 bp, Homo sapiens
  misc_feature: GYAE6OF02H2HHR.27.78.H01.1.454.CMB.1.raw
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatcgtgggacactatttcaccctcaccatcaatagcctggaanctagaagatgctgctaacttattactgtcatcagacgttacttactttacctactaagtgacttccaccttcggaccgaaagggtaccacggtactagggaacgtaacgtttaaaccgaacttggtaggtctacggaccaaccgtattccgttgtttacc

SEQ ID NO: 171777 - DNA, 550 bp, Homo sapiens
  misc_feature: GYAE6OF02GLH2X.27.78.H01.1.454.CMB.1.raw
  modified_base (442)..(442): a, c, t, g, unknown or other
  misc_feature (442)..(442): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttctcacggggtcccctcgacggttcagtggcagtggatcgtgggacacatttccaccctcaccatcaatacgcctaggaagctagaagatgctagacctaacttattactgtcatcagtatacttactttacctnaagtgactcctaccgttcggaccgtaaagggaccaacgacgtaggaacgtaacttaaaccgaacgttaggtacggacgtacgaccaacctatccgttgtcctttaccg

SEQ ID NO: 171778 - DNA, 564 bp, Homo sapiens
  misc_feature: GYAE6OF02I02RO.27.78.H01.1.454.CMB.1.raw
  modified_base (150)..(150): a, c, t, g, unknown or other
  misc_feature (150)..(150): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
tcagagcgtcgtctcacgaccggtgctcgatttagtgtgagtagtttgggtttggggatgagacaaaactcgacaaggtcaaggccaggaagatgttgccatcacaactcattgggtttctgctgcttctgggttccagcctcaggggtnaaattgtgcctgactcagtctccagactttcagtctgtgactccaaaggagaaagtcaccatcacctgccgggccagtcagagcgttggagtagcttacacttggtaccagtcagaagccaggtcagtctccaaagctcctnatcaagtatgcttccagtcctctcagggtcccctgagttcagtgcagtgatctggacanatttcacctcaccatcaatagcctgaagctagagatgctgactaacttattactgtcattcagtactactacctttacctacaacgttcaacttctacctttcggaccctaaagggaccaacgtacttacggtaagtaacgtttaaaccggaacgtacgttacgggtaccttagggaccctaccgtaacttccgttacggttacctttacccg

SEQ ID NO: 171779 - DNA, 674 bp, Homo sapiens
  misc_feature: GYAE6OF02F7FLF.27.78.H01.1.454.CMB.1.raw
tcagagcgtcgtctcacgaccggtgctcgatttagtgtgagtagtttgggtttgggggtagtcttaaaagaggttactttcgtctgggatggtggcatagagcgaaaactgacaagtccaagggctaggaagtatgttgccatcacaactcattgggtttctgcgtgctctgggttccagccctcagggtcaaattgtcgctgactctagtcgtccagacgtttcagtctgtacgactccaaaggacaaagtccaaccatctacctgccggccagtacagagcgttggtagtagtcgttacacgtggtaaccagcagaagccaggtcagtctccaaagcttcctgatcaagtacgtgccgttcccagtcccttctcgacggggttcccctgacggttcaggttgggacctaggtgtactcgtacgggactacgtacttttacgacccctcgaccctatacaaacgtacgaccgtaggaacgtcgttaggaacgtagttacgtacttagtacctaaacgtttattaacgttagttactaacgttacctaacggtaacgttaaccgttaaccgtttacccgtacgtaaacggttcggtaacttacccgtaaccgttaccggaaccgtaacggggtacctaaccggtacgtacgggtaacgtaacgttaaaacccgg

SEQ ID NO: 171780 - DNA, 496 bp, Homo sapiens
  misc_feature: GYAE6OF02G7VB9.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgctaacttattactgtcatcagatactactttacctcaagtgatcaccttcggaccaagggcacgactggagtataacgatgtgctgcaccatctgtcttc

SEQ ID NO: 171781 - DNA, 711 bp, Homo sapiens
  misc_feature: GYAE6OF02JA5UY.27.78.H01.1.454.CMB.1.raw
tcagagcgtcgtctcacgaccggtgctcgatttagtgtgagtagtttgggttgggggccaaactgaccgctaaaacgtgaacaacgtcaaggcaggaagatcgttgccatcgacaacgtccagttgggtttctgcctttgtcgttcgtgggttccagaccctaccaggggttgaaacttgtcgcgttgactcaggtctcctagtacgtttcagttctgtgacgtaccgaaaaggacgaaaggtccaccagttcgaaccgtgcccgggccagtacgacgtaggtcggtttaggtacgttacgacttacacgttaggtaccaggtcgagaacgccaggtccagtctaccgaagtctccgtcgagtcgaagtgtgtccttcccgagttccctttacgtacgtacggggtccccctacggtacggttactaggtcggcgtagtaggactcgtagggacacgtactttaccaccctcgaccactaccaagtacgaccgtaggaacgacgtagaacgacgtcgactgacctaacttagttacgtgtaccatacgagtacgttaaccgttacgttacccgtacgtaacgttctaacttaccgtacccgttacggaccgtaaggaccgtacggtaacggtaggtaacgttaacgttaaaccgtacgttaccgttaggttacgtacggtaccgtaccggtacgttacccgtacgttaccg

SEQ ID NO: 171782 - DNA, 534 bp, Homo sapiens
  misc_feature: GYAE6OF02JFU06.27.78.H01.1.454.CMB.1.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctaccaaagctcctcatcaagtatgaccttcccagtccttctcagggtcccctgagttcagtgcagtgatcgtggacacattcacctcaccatcaatacgcctaggaanctagaagatgctagactaacttattactgtacaatcaagtactacttactttacctacaagtgaactccaccgttcggaccaaagggaccacgactaggaagaacgttaaacgacttaggcggactacggacaccgtattcctggttcttacg

SEQ ID NO: 171783 - DNA, 687 bp, Homo sapiens
  misc_feature: GYAE6OF02JPLM4.27.78.H01.1.454.CMB.1.raw
  modified_base (273)..(273): a, c, t, g, unknown or other
  misc_feature (273)..(273): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtagaaattgtgctgactcagtctccagtactttcagtctgtgactaccaaaggaagaaagtacaccatacacctcggccgggccagtacagaggtcggttaggtagtagacttacactcgtacagcnaaggaaagaccgacggtacgtacgtaccgtaccaaacgtacctaccctactaactactaaagtaagtacgtaccttaccctacgttaccctttaccttaccggtaccggggttaccccgtaccggtacgggttacgtacggtacgggtacgtaggtaggtacgtacgtacgggtaacgaactacttacctaccctaccaaccaactactaataacgtaccgtacggaagacgtagaaagaagtagtacgtacgtactaacttaaactttaactacgttactactactaagtaacgttaacttaacctttaaccttactaacgtagtactacctacctacgtaccgaacggaacgaccgtaacgtacggtaacggtaacgttaaacgtaaccgtacggtacggtacgtacgtacg

SEQ ID NO: 171784 - DNA, 548 bp, Homo sapiens
  misc_feature: GYAE6OF02JJ3WB.27.78.H01.1.454.CMB.1.raw
tcagagcgtcgtctcacgaccggtgctcgatttagtgtgagtagtttgggtttggggtagtcttaaaagaaggttctttcttctgggatgtggcatgagcaaaactagacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctcctcatcaagtatgcttcccagtccttctcgacggggtcccctgaggttcagtggcagtggatcgtgggacactattcaccctcaccatacaatacgcctaggaagctagaagatcgctcgctaacttattactgtcactcgagacgtacttacctttacctacaagttcgattactacccttacggaccgaacgggtacaccgatacggtaacgtattaaaaccg

SEQ ID NO: 171785 - DNA, 537 bp, Homo sapiens
  misc_feature: GYAE6OF02H13JS.27.78.H01.1.454.CMB.1.raw
  modified_base (398)..(398): a, c, t, g, unknown or other
  misc_feature (398)..(398): n is a, c, g, or t
  modified_base (450)..(450): a, c, t, g, unknown or other
  misc_feature (450)..(450): n is a, c, g, or t
tcagagcgtcgtctcacgaccggtgctcgatttagtgtgagtagttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtccttctcgacggggtcccctcgacggttcaggtggcaggtggatcgtgggacactactttccaccctcaccatcaatacgcctaggagctgaagntgctgactaactttatactgttcatcagagtaccttactttacctacaagtnacttcctaccttacggaccaaagggaccacggtacgtaggaagtaacttaaacggactggtacggctcgacacctatctcgtcttac

SEQ ID NO: 171786 - DNA, 499 bp, Homo sapiens
  misc_feature: GYAE6OF02F9VGR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccgttcggccaagggacacgactggagacttaaacgactgtgctgcaccatctgtcttc

SEQ ID NO: 171787 - DNA, 603 bp, Homo sapiens
  misc_feature: GYAE6OF02JLEBC.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatccacctgccggcagtcagagcgttggtagtagcttacactggtaccagcaagaagccaggtcagtctaccaaagctacctcatcaagtactgccttccagttccttccgtccgacggggttcccctcggtacggttcaggttcggacctagggtcggtactcggtacggggaacctacgtactttcccgaacccctacaaccactacaaacgtacgtaccgtaggaacgtcgtagaacgacgtcgactcgacctaaacttattactagtacatcagtaacgttacttacctttactacaagtcgacttacctaaccgttacggaccgaacggtaccgacgtacgtacggtagtaacgtaaacg

SEQ ID NO: 171788 - DNA, 513 bp, Homo sapiens
  misc_feature: GYAE6OF02JER9R.27.78.H01.1.454.CMB.1.raw
  modified_base (195)..(195): a, c, t, g, unknown or other
  misc_feature (195)..(195): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcaccctcacccatcaatagcctggaagctgaagatgctgacaacttattactgtcatcagtagtacttactttaccanagtnatcaccgttcggaccaagggacacgactaggaacgtaattaaaccgaactgnggtactcgacaccatctgtcttc

SEQ ID NO: 171789 - DNA, 577 bp, Homo sapiens
  misc_feature: GYAE6OF02IOUGJ.27.78.H01.1.454.CMB.1.raw
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtgcagtgatcgtggacactattcaccctcaccatcaatacgcctggaagctagaagatgctgactaacttattactgtacatctaagagttaaccttactttaaccctacgtaaacgtgaacttcctacccgtttacgggaccaaacggggtacaccggaacgtgggaaagtaaacgtttaaaaccggaacttaggtaacggccttacggaccctaaccctaattcccgttaggttaccc

SEQ ID NO: 171790 - DNA, 498 bp, Homo sapiens
  misc_feature: GYAE6OF02GNZUL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtgatctggacacatttcaccctcaccatcaatagcctggaagctagaagatgctgactaacttattactgtcatcagatactactttaccactaagtgatcaccttcggaccaagggacacgactggagaattaaacgactgtgctgcaccatctgtctc

SEQ ID NO: 171791 - DNA, 519 bp, Homo sapiens
  misc_feature: GYAE6OF02HE7MS.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatccacctgccgggccagtcagagcgttggtagtagcttacactggtaccagcagaagccaggtcagtctccaaagctctcatcaagtatgcttcccagtccttctcacgggtccctcgagttcagtgcagtgatcgtggacacgatttcaccctcaccatcaatacgcctggaagctagaagatgctgactaacttagttactgtcatcagtagtactacttacctactaagtcgatctaccgttcggaccaagggaccacgtactggtagattaaacgg

SEQ ID NO: 171792 - DNA, 508 bp, Homo sapiens
  misc_feature: GYAE6OF02FZ1BH.27.78.H01.1.454.CMB.1.raw
  modified_base (195)..(195): a, c, t, g, unknown or other
  misc_feature (195)..(195): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtggacacatttcaccctcaccatcaatagcctggaagctgaagatgctgcaacttattactgtcatcagtagtactactttacacagtnatcaccttcgaccaaggacacgactggagtaattaaacgaactgtacggctcgcacctatcgtcgtcttacc

SEQ ID NO: 171793 - DNA, 551 bp, Homo sapiens
  misc_feature: GYAE6OF02GOUWE.27.78.H01.1.454.CMB.1.raw
  modified_base (435)..(435): a, c, t, g, unknown or other
  misc_feature (435)..(435): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaagtatgcttcccagttcccttctcgacggggtcccctcggacggttcagtcggcaggtggatcgtggggaccactatttccacccctcaaccatacaatcgcctaggaacncgtagaagatgctgactaacttattactgtcatcagtactacttactttaccataagtnaacttcctaccgttcggacccgaagggaccaacggacgtaggaacgtattaaaccgg

SEQ ID NO: 171794 - DNA, 504 bp, Homo sapiens
  misc_feature: GYAE6OF02FZCZ1.27.78.H01.1.454.CMB.1.raw
  modified_base (228)..(228): a, c, t, g, unknown or other
  misc_feature (228)..(228): n is a, c, g, or t
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttcccagtccttctcaggggtccctgaggttcagtggcagtggatcgtgggacacatttcaccctcaccatcaatagcctggaagctgaagatgctgcaacttatactgtcatcagtagtactactttaccnaagtgatctaccttcgaccaaggacacgactaggagataaacg

SEQ ID NO: 171795 - DNA, 511 bp, Homo sapiens
  misc_feature: GYAE6OF02F5QM9.27.78.H01.1.454.CMB.1.raw
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatcgtgggacacatttcacccctcaccatcaatacgcctggaanctgaagntgctgacaacttattactgtcatcagtagtactactttaccnaagtnatcaccttcggaccaaggcacgactgganattaaaccg

SEQ ID NO: 171796 - DNA, 526 bp, Homo sapiens
  misc_feature: GYAE6OF02HI27P.27.78.H01.1.454.CMB.1.raw
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatctgggacacatttcaccctacaacctatcaaatacgcctaggaagctagaagatgctgactaacttatacttgtcatcagatactacttacctnaagtgatctaccttcggacaagggaccacgactaggaagtaacttaaacgaactggtacggctgacaaccctatccttgtccttacg

SEQ ID NO: 171797 - DNA, 533 bp, Homo sapiens
  misc_feature: GYAE6OF02GNVD6.27.78.H01.1.454.CMB.1.raw
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggcagtcagagcgttggtagtagcttacactggtaccagcagaagccaggtcagtctccaaagctcctcatcaagtatgcttcccagtccttctcacggggtccctcgaggttcagtggcagtggatcgtgggacacatttccaccctcaccatcaatacgcctaggaanctagaagatgctgacctaactttataactgtacatcaagtacgtacttacctttacacgtaagtcatcctaccgttcggaccaagggaccacgactaggacgtaattaaaccgg

SEQ ID NO: 171798 - DNA, 552 bp, Homo sapiens
  misc_feature: GYAE6OF02GI7T2.27.78.H01.1.454.CMB.1.raw
  modified_base (381)..(381): a, c, t, g, unknown or other
  misc_feature (381)..(381): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcagggtcccctgaggttcagtggcagtggatctgggacacatttcaccctcaccatcaatgcctggaanctgaagatgctgactaacttattactgtcatcagtagtacttaactttacctctaagttcgattacctacccttcggaccctaaggggaccacgtacctagggaactaacgttaaaaccggaacgttaggtacggaccgttaggaccctaccgtacgttccttagttaccc

SEQ ID NO: 171799 - DNA, 565 bp, Homo sapiens
  misc_feature: GYAE6OF02F59LH.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgccttcccagtccttctcgacggggtcccctcggtaggttcagtggcagtggatcgtggacactactttcaccctcaccatcaatagcctaggaagctagaagtatgctgactaacttattactgtactatcaagtacgttactacctttacctactaagtcgaatcctaccgtttcggaccgtaaagggaccaacggtacgtaggaacgtaacgttaaaaccgaacgtcgtaggtactacggacctaacccgattccgttcgtcttacc

SEQ ID NO: 171800 - DNA, 556 bp, Homo sapiens
  misc_feature: GYAE6OF02JG0EP.27.78.H01.1.454.CMB.1.raw
  modified_base (459)..(459): a, c, t, g, unknown or other
  misc_feature (459)..(459): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcgacggggtcccctgaggttcagtggcagtggatcgtggacacactttccaccctcaccactacaactacgcctaggaactctagaaagtatcggactagactaaacttataccttgtcagtcaagtactacttacttactactaagtnactcaccgttcggactaagggacacggtctagggaactaacgttaaacgactaggtaccgcgttacggaccaaccgtagtccttaggtaccttaccg

SEQ ID NO: 171801 - DNA, 533 bp, Homo sapiens
  misc_feature: GYAE6OF02HX3PH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcaccatcaatacgcctagggaacgtctagaaagatgacttaactaacttaattactgtctatcaagagtactactttacctcaagttcgatctaccgttcggaccaaaggacacgtactaggaatagtaaaacgactggtaggtctagcacctagtctgttcttactac

SEQ ID NO: 171802 - DNA, 503 bp, Homo sapiens
  misc_feature: GYAE6OF02ICNSL.27.78.H01.1.454.CMB.1.raw
  modified_base (488)..(488): a, c, t, g, unknown or other
  misc_feature (488)..(488): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctagaagatgctagctaacttattactgtcatcagagtacttactttactcaagtgatcaccttcggaccaagggacacgactggaatataaacgactgngctgcacatctgtcc

SEQ ID NO: 171803 - DNA, 510 bp, Homo sapiens
  misc_feature: GYAE6OF02G2Z1M.27.78.H01.1.454.CMB.1.raw
  modified_base (469)..(469): a, c, t, g, unknown or other
  misc_feature (469)..(469): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcacgggtccctgagttcagtggcagtggatcgtgggacacgtatttcaccctcaccatcaatagcctggaagctgaagatgctgcaacttattactgtcatcagtagtactacttacctctaagtnatctaccttcggaccaaggacacgactaggacgtataaacg

SEQ ID NO: 171804 - DNA, 656 bp, Homo sapiens
  misc_feature: GYAE6OF02FTCGF.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcggccggccagtcagagtcggttaggtagtagtcttacacgttcggtaaccagcaagaacgccgaggtcgacgtcctaaccgaaagtcctccctactataccgaaagttatcgtcccttacccacgttcccttcctcggtaccggggttcccctaggtacggttcaggtcggcgtaggtcggtacttcggtacggggaacctaacgtacttttacccaccccttaccaaccctacgtaacctaaacgtaccgtcccgttaagggaacgtcgtaaggaagtatcgtctacgtacctaactttacttacgtacgtactactcgaagtacgttaaccttacctttaccacgtaagtgtactacctaccgttacgaccgaacggaccacgtacgtaggtacgtaagttaaaccgg

SEQ ID NO: 171805 - DNA, 530 bp, Homo sapiens
  misc_feature: GYAE6OF02HJ9TS.27.78.H01.1.454.CMB.1.raw
  modified_base (199)..(199): a, c, t, g, unknown or other
  misc_feature (199)..(199): n is a, c, g, or t
  modified_base (451)..(451): a, c, t, g, unknown or other
  misc_feature (451)..(451): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcgacgggtccctcgaggttcagtggcagtgatctgggacacactttccaccctcaccatacaatacgcctggaagctagaagtatgctgactaacttattactgtactatcagtactacttactttacctacaagtnatccaccgttccgaccagggaccacgtactaggaataacgttaaacgaacgttgtggtctacgaccacgtatctgttcc

SEQ ID NO: 171806 - DNA, 606 bp, Homo sapiens
  misc_feature: GYAE6OF02JIBHT.27.78.H01.1.454.CMB.1.raw
  modified_base (394)..(394): a, c, t, g, unknown or other
  misc_feature (394)..(394): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtaagagcgttggtagtagcttacactggtaccagcagaagccaggtcaagtctccaaagctcctcatcaagtatgcttcccagtccttctcacggggtcccctgacggttcagtggcagtggatcgtgggacacgtatttccaccctcaaccatacaatacgcctaggaanctagaagatgctgactaacttatactgtacatcgaagtagttacttaacgtttaccacgtaagttcgaacttaccgtacccgtttaccgggaccctaaacggggaacctaaccggtaacgttacgggaaacggtaaacgtttaaaaaccgaacggttacggttaccggtacgttacgacctaaccgttaacttacgttcgttaccttaaccg

SEQ ID NO: 171807 - DNA, 506 bp, Homo sapiens
  misc_feature: GYAE6OF02ITE53.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgctaacttattactgtcatcaagtagtactacttacctacaagtgatcaccttcggaccaagggacacgactggagtaattaaacgactgtaggctgcaccatctgtctac

SEQ ID NO: 171808 - DNA, 513 bp, Homo sapiens
  misc_feature: GYAE6OF02JKD3H.27.78.H01.1.454.CMB.1.raw
  modified_base (195)..(195): a, c, t, g, unknown or other
  misc_feature (195)..(195): n is a, c, g, or t
  modified_base (380)..(380): a, c, t, g, unknown or other
  misc_feature (380)..(380): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgactaacttattactgtcatcagagtactactttacctacaagtgatctaccttcggacctaagggacacgactggagtaacttaaacgactgtaggtctacgacacctatctacgtcttac

SEQ ID NO: 171809 - DNA, 581 bp, Homo sapiens
  misc_feature: GYAE6OF02GXPLN.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcagtggcagtggatcgtgggacacatttccaccctcaccatcaatacgcctggaagctagaaagatgctgactaacttattactgtacatcaagtacgtaacttaccttttaacctactaagtcgtacttaccgtaccgttcggacccgaacgggtaccacgtacgtagggaacgtaaacgttaaaccggtaacgttacggttacggaccgttacggacctaacccgtacttaccgtcgttacccg

SEQ ID NO: 171810 - DNA, 568 bp, Homo sapiens
  misc_feature: GYAE6OF02IHW2J.27.78.H01.1.454.CMB.1.raw
  modified_base (508)..(508): a, c, t, g, unknown or other
  misc_feature (508)..(508): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctaccaaagcctcctcatcaagtatgtccttcccagttcccttctcgacggggttcccctcggtacggttcagtggcaggtggatcgtggactactatttccaccctcacctatacaatacgaccgtaggaacgtcgtagaagatcgctgacctaactttactactgtcatcaagtacgttaccttaactttacctactagtntaactcctacccgttacggaccgaacgggaccaccgtaagtacggactaagttaaaccgg

SEQ ID NO: 171811 - DNA, 549 bp, Homo sapiens
  misc_feature: GYAE6OF02JKWM3.27.78.H01.1.454.CMB.1.raw
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggagtgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctctcatcaagtatgcttcccagtccttctcagggtcccctgaggttcagtggcagtggatctgggacacacgttttcaccctcaccatcaatgcctggaanctgaagatgctgcaacttattacngtcatccagtactacttactttaccncaagttgacttccacctttcggacctaagggaccacgtacctagggacgtaactttaaaaccgacgttcgacggtacttacggacccaaccgtaattccgttaggtcctttaccg

SEQ ID NO: 171812 - DNA, 518 bp, Homo sapiens
  misc_feature: GYAE6OF02G3DCK.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcggaggttcagtggcaggtggatcgtgggacacactttcaccctcaccatacaatagcctggaagctgaagatgctgactaacttattactgtcatcagtagtactactttacctctaagtgattcaccgttcggaccaagggacacgactaggagtaattaaacggactggtgctgccaccatctgtcc

SEQ ID NO: 171813 - DNA, 514 bp, Homo sapiens
  misc_feature: GYAE6OF02FXT37.27.78.H01.1.454.CMB.1.raw
  modified_base (229)..(229): a, c, t, g, unknown or other
  misc_feature (229)..(229): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggccagtcagagcgttggtagtagcttacactggtaccagcagaagccaggtcagtctccaaagctcctcatcaagtatgcttcccagtccttctcagggtcccctcgaggttcagtggcaggtggatctgggacacatttccaccctcaccatcaatacgcctggaagctgaaagatgctgacaacgtttattactgtcatcagtagtactacttaccnctaagtgatcaccttcgacctaacggacacgactggagtataaacg

SEQ ID NO: 171814 - DNA, 496 bp, Homo sapiens
  misc_feature: GYAE6OF02FIVIH.27.78.H01.1.454.CMB.1.raw
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagtagtactactttaccncaagtgatcaccttcggccaagggacacgactggagtattaacgactgtgctgcaccatctgtctc

SEQ ID NO: 171815 - DNA, 506 bp, Homo sapiens
  misc_feature: GYAE6OF02HIHBO.27.78.H01.1.454.CMB.1.raw
  modified_base (440)..(440): a, c, t, g, unknown or other
  misc_feature (440)..(440): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtgatctgggacacatttcaccctcaccatcaatagcctggaagctagaagatgctgcaacttattactgtcatcagagttactactttacctacaagtnactcaccttcggaccaagggaccacgactggaagacttaaacgaactgtggctgcaccatctgtcc

SEQ ID NO: 171816 - DNA, 521 bp, Homo sapiens
  misc_feature: GYAE6OF02JADZG.27.78.H01.1.454.CMB.1.raw
  modified_base (474)..(474): a, c, t, g, unknown or other
  misc_feature (474)..(474): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtcccttctcacggggtcccctgaggttcagtggcagtggatctgggacacatttccaccctcaccatacaatacgccctggaacgctagaagatgctgctaacttattactgtcattcagtatactactttaccanagtctatctaccgttcggccaacggacacgacgtacggatataaacg

SEQ ID NO: 171817 - DNA, 513 bp, Homo sapiens
  misc_feature: GYAE6OF02F4CJ8.27.78.H01.1.454.CMB.1.raw
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattcaccctcaccatcaatgcctaggagctgaagatgctgacaacttattaactgtcatcagagttactactttacctcaagtgatcacccttcggaccaacgggacacgacgtaggaagtaacttaaacgaacgtgtaggctagcaccntctgttc

SEQ ID NO: 171818 - DNA, 538 bp, Homo sapiens
  misc_feature: GYAE6OF02I2BJB.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatcgtgggacactatttcaccctcaccatcaatacgcctaggaacgctagaagatcgctgactaactttattactgtacatacagtacgttacttactttacctctaagtgtactctaccgttcggaccgtaacgggacacggacgtacggagtattaaacgg

SEQ ID NO: 171819 - DNA, 545 bp, Homo sapiens
  misc_feature: GYAE6OF02IKE1K.27.78.H01.1.454.CMB.1.raw
  modified_base (196)..(196): a, c, t, g, unknown or other
  misc_feature (196)..(196): n is a, c, g, or t
  modified_base (395)..(395): a, c, t, g, unknown or other
  misc_feature (395)..(395): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatacgcctggaacgctagaagntgctgactaacttattactgtcatcagattactactttaccactaagttcgattccaaccctttcggaccgtaaagggaccaacggtacgtaggaagtaacgtttaaaccgaacgttgtaggactcggacaccctagtctcgtccttacg

SEQ ID NO: 171820 - DNA, 541 bp, Homo sapiens
  misc_feature: GYAE6OF02H1D8Q.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcaggtgatcgtgggacacgatttccaccctcaccatacaatacgcctaggaacgcttagaagatgctagactaacttattactgttcatcaagacgttacttacctttaccactaagtcgattccaccttcggaccaagggaccacgtacgtaggaatacttaaacgacttaggcggtactcggctaccgattccgtattacc

SEQ ID NO: 171821 - DNA, 834 bp, Homo sapiens
  misc_feature: GYAE6OF02H09AL.27.78.H01.1.454.CMB.1.raw
  modified_base (214)..(214): a, c, t, g, unknown or other
  misc_feature (214)..(214): n is a, c, g, or t
tcagagcgtcgtctcacgaccggtgctcgatttagtgtgagtagtttgggtttggggatgagacaaaactgacaagtcaaggcaggaaacgatgttgccatcacaacctcacttgggtttctgcgtcgcgtcgtgggtttccagtccttccgagggggtgaaagttgtgcctagaacttcacgtctcccagtactttcagtctgtgactcaagnggaatcacatcactcgcgggccagtcagagcgttcggtagtagacgttactactgggtacctagacctacgaacgccaggttcagtactccgaaaaggcctccctacgactcctaaaggtaactacggaccctttcccgaaggttcccgtttacgttccggaacgggggttccccccgtaccggtaaccgggtttaccaacggttcgggtccgtaacggtgggtaacgtttccggttacggggaacctaacccgtaacttttcccgaacccccgtaccaaaccctaacttaccaaagtttaaccggacccttaacgggaaaccgtcctaacggtaaaacgtaaacgtacgtacgtaacgaacctaaaccgttttaacgtttaaccgttaggtaaccgtaacttaccgtaaaggtaacgttaacctttaccgtttaaccgtaacgtaaacggttacgtaaccttacccgttaaccgttttaccgggaccgtaaacggggtacctaacgggtaccgttacgggaacggttaaacgtttaaacccgggaaacgttagggtaaccggtacgtaccggtaccgtaacccgttaacgtttccgttacgtttaccgtttaacccggg

SEQ ID NO: 171822 - DNA, 562 bp, Homo sapiens
  misc_feature: GYAE6OF02GYH6Z.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgcttcccagtcccttctcgacggggtcccctcggacggttcaggtcggcaggtggactcgtgggacactactttccaccctcaccatacaatacgcctaggaacgctagaagatgctgactaacttattactgtactatacagtacgttacttacctttacctactaacgtgaactctaacccgttcggaccgaacgggaccacggtaccgtaggtacgtaagttaaaccgg

SEQ ID NO: 171823 - DNA, 499 bp, Homo sapiens
  misc_feature: GYAE6OF02G6IL3.27.78.H01.1.454.CMB.1.raw
  modified_base (414)..(414): a, c, t, g, unknown or other
  misc_feature (414)..(414): n is a, c, g, or t
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctggacgttcagtggcagtggatcgtgggacacatttcaccctcaccatcaatagcctggaacgctagaagatgctgactaacttattactntcatcagagtactacttacctcaagtgatcacttcggacaaggcacgatgganaattaacgactgngntagccactatctgtctc

SEQ ID NO: 171824 - DNA, 554 bp, Homo sapiens
  misc_feature: GYAE6OF02F9LYA.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtccgtgactccaaaggagaaagtcaccatcacctgccgggccagtcagagcgttggtagtagcttacactggtaccagcagaagccaggtcagtctccaaagcctcctcatcaagtatcgtcttcccagtccttctcacggggtcccctgacggttcagtggcagtggatctgggacactatttccaccctcaccatcaatagcctaggaagctagaagatgctgactaacttattactgtacatcagtataacttactttacctactaagtacgtactcctacccgttaccggaccgtaaacgggaccaacggtaccgtaggaacgtagttaaaccgaacgg

SEQ ID NO: 171825 - DNA, 507 bp, Homo sapiens
  misc_feature: GYAE6OF02HC622.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatacgcctggaagctagaagatgctgacaacttattactgtcatcagtagtactactttacctcaagtgatcaccttcggaccaagggacacgactaggagtaattaaacgactgtggctgcaccatctgtcttac

SEQ ID NO: 171826 - DNA, 495 bp, Homo sapiens
  misc_feature: GYAE6OF02FOUMB.27.78.H01.1.454.CMB.1.raw
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtnatcacttcggcaagggacacgactgganaattaacgaactgtagctgcacatctgtc

SEQ ID NO: 171827 - DNA, 557 bp, Homo sapiens
  misc_feature: GYAE6OF02IAJWF.27.78.H01.1.454.CMB.1.raw
  modified_base (404)..(404): a, c, t, g, unknown or other
  misc_feature (404)..(404): n is a, c, g, or t
  modified_base (469)..(469): a, c, t, g, unknown or other
  misc_feature (469)..(469): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatacaagtatgccttcccagttccttctcgacggggtcccctcggaggttcaggtggcaggtggatcgtgggactacatttccaccctcacccataccaatacgcctaggaacnctagaaagatgctagactaactttattactgtacatcagtacgttacttactttacctacaagtntacttctaccgttacggaccaagggacacgacgtagggtaagtaacttaaacggacttagtaggtctcgaccacctattcctgttacc

SEQ ID NO: 171828 - DNA, 529 bp, Homo sapiens
  misc_feature: GYAE6OF02J2L1H.27.78.H01.1.454.CMB.1.raw
  modified_base (228)..(228): a, c, t, g, unknown or other
  misc_feature (228)..(228): n is a, c, g, or t
  modified_base (382)..(382): a, c, t, g, unknown or other
  misc_feature (382)..(382): n is a, c, g, or t
tcagagcgtcgtctcacgaccggtgctcgatttagtgtgagtagtttgggtttggggatcttaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggnaaagtcaccatcacctgccgggccagtcagagcgttggtagtagcttacactggtaccagcagaagccaggtcagtctccaaagctctcatcaagtatgcttcccagtccttctcacggggtcccctgacgttcagtgcagtggatctgggacncatttcaccctcaccatcaatacgcctggaatctgaagatgctgactaacttatactgtcatcagacgtacttactttacactaagtcgactactaccctttacggaccctaaggggtaccacgtaccgtaggtacgtattaaaccg

SEQ ID NO: 171829 - DNA, 516 bp, Homo sapiens
  misc_feature: GYAE6OF02G6EOE.27.78.H01.1.454.CMB.1.raw
  modified_base (149)..(149): a, c, t, g, unknown or other
  misc_feature (149)..(149): n is a, c, g, or t
  modified_base (315)..(315): a, c, t, g, unknown or other
  misc_feature (315)..(315): n is a, c, g, or t
  modified_base (512)..(512): a, c, t, g, unknown or other
  misc_feature (512)..(512): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtcccttntccgaggggtcccctcgaggttcagtggcagtggatcgtgggacacatttccaccctcaccatccaatacgcctaggaagctagaaagatgctgactaacttattactgtcatcagatacttactttacctcaagtgacttccacttcggacaagggcacgacgtggaacaattaacgatgtgctggaccacattcngttc

SEQ ID NO: 171830 - DNA, 1010 bp, Homo sapiens
  misc_feature: GYAE6OF02GLLAO.27.78.H01.1.454.CMB.1.raw
tcagagcgtcgtctcacgaccggtgctcgatttagtgtgagtagtttgggtttggggtagtgaggcaaaacgtgacaacgtcaacggtcgaggtaacgatgttgccactcacgaactcagttggtttctgactgactctcggttccacgcctccgaggggttggaattggtgctggttaccttcgtagtcctaccttaaggtactttcagtctgtgactccaaaggagtaaaggtcgaaccgtacggtcaccttggcccgggccgacgggtccagacgtcgttggtagtagtctacacgtcgtaccaggctagaagcctaggtctagtcctaccgaaagtcttacctcacgtccaacgtattcgccgtttaccccggaaggttccctttcggtaccgtacgggggttacccccttcgggtaaccgggttttactaacggttaccggaacccgtaggttaacgggaacgtttaccgtacggggaaccttaaacgttacgttttacccgaacccctttccgaaccccgttaacgttacgtaaaaccgttaacgggccccgtttaacggggtaaaccgtaccgttaacggtaaacggtaacgttacgggtaccgttacggtaaccgttaaaccgtttttaacgtttaaacgtaacggtttaaccgtaaaccgtttaccgttaaacgggttaaaccgttttaacccggtttaaaccctttttaaacccgtttaaccgtaaaccggtttaacgttaacccgtttaacccgtaaaaccccggtttttacccgggaaaccccgggtaaaaacccgggggtacccgttaaaccggggttaaccgtttaaccggggtaaaccggtttaaaaaccggtttaaaacccggtaaaaccgggtttaaccgggttaaccgggttaaccccggtttaaccgggttaaccccgttttaaaaccccgggtttaaccgtttttaacccgggttttacggttttaaccccccggtttttaaacccccgg

SEQ ID NO: 171831 - DNA, 542 bp, Homo sapiens
  misc_feature: GYAE6OF02GT5R4.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtggcaggtggatcgtgggacactatttcaccctcaccatcaatacgcctaggacgctgaagatgctgactaacttattactgtcatcagtagttactactttacctacgtaagtcgtactccaccgtttccggaccgtaacgggaccaaccgtacgtacggtagaagttaaacgg

SEQ ID NO: 171832 - DNA, 524 bp, Homo sapiens
  misc_feature: GYAE6OF02JENO1.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtccctcgaggttcagtgcagtggatcgtgggacacatttcacctcaccatcaatagcctggaagctagaagatgctgcaacttattactgtacatcagagtactactttacctctaagtcgatcaccttcggaccaagggacacgacttagggaacgtaacttaaacgaacttgtaggactggacctaccgattcgtcgttcttacc

SEQ ID NO: 171833 - DNA, 489 bp, Homo sapiens
  misc_feature: GYAE6OF02HBL8T.27.78.H01.1.454.CMB.1.raw
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctnaccatcaatagcctggaagctgaagatgctgacaacttattactgtcatcagatactactttacctnaagtnatcaccttcgcaaggcagctggagataacgactgngcngcaccatctgtctac

SEQ ID NO: 171834 - DNA, 530 bp, Homo sapiens
  misc_feature: GYAE6OF02GIVFF.27.78.H01.1.454.CMB.1.raw
  modified_base (426)..(426): a, c, t, g, unknown or other
  misc_feature (426)..(426): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcctaccaaagcctcctcatcaagtatgcttcccagtccttctcacgggtcccctgacggttcagtggcagtggatcgtgggacactatttccaccctcaccatcaaatacgcctaggaacnctagaagactgcttactaacttattactgtcatcagagttaactacttacctcaagtgactctaccgtcggacgaaggacacgactaggacgtataacgtaacg

SEQ ID NO: 171835 - DNA, 494 bp, Homo sapiens
  misc_feature: GYAE6OF02H181Q.27.78.H01.1.454.CMB.1.raw
  modified_base (195)..(195): a, c, t, g, unknown or other
  misc_feature (195)..(195): n is a, c, g, or t
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggagtagcttacactggtacccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagatactactttacctcaagtgatcaccttcggccaaagggcacgatggagattaaacgaactgtgntgcacatctgtcttc

SEQ ID NO: 171836 - DNA, 499 bp, Homo sapiens
  misc_feature: GYAE6OF02FPWTQ.27.78.H01.1.454.CMB.1.raw
  modified_base (195)..(195): a, c, t, g, unknown or other
  misc_feature (195)..(195): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacactttcaccctcaccatcaatagcctggaanctgaagntgctgcaacttattactgtcatcagagtacttacttacctnaagtnatcacttcgaccaaggacacgactggagtaattaaacgactgtacgcgtgcaccatctctctc

SEQ ID NO: 171837 - DNA, 509 bp, Homo sapiens
  misc_feature: GYAE6OF02GDQTB.27.78.H01.1.454.CMB.1.raw
  modified_base (381)..(381): a, c, t, g, unknown or other
  misc_feature (381)..(381): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatctgggacacatttcaccctcaccatcaatagcctggaanctagaagatgctgacaacttattacttgtcatcagtagtactactttacctacagtnatcaccttcggaccaagggacacgactggaagtaacttaaacgactgtacgctcgacaccatctgtcttac

SEQ ID NO: 171838 - DNA, 504 bp, Homo sapiens
  misc_feature: GYAE6OF02HVWME.27.78.H01.1.454.CMB.1.raw
  modified_base (198)..(198): a, c, t, g, unknown or other
  misc_feature (198)..(198): n is a, c, g, or t
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggatgggagcaaaaactgacaagtcaaggcaggaagatgttgccatcacaactcattgggtttctgctgctctgggttccagcctccaggggtgaaattgtgctgactcagtctccagactttcagtctgtgactcgaaaggngaaagtcaccatcacctgccggccagtcagagcgttggagtagcttacacgtggtaaccagtcagaagtccaggtcagtctccaaagctcctacatcaagtatgcttccagtcctctcagggtcccctgaggttcagtgcagtgatcgtggacacatttcaccctcaccatcaatgcctaggacgtctgaagactgctgacaacttattactgtcatcagatactatttaccanaagtgatctaccgttcggaccgaagggacagactggagaattaaacgactgtaggctgccaccatctgtctc

SEQ ID NO: 171839 - DNA, 529 bp, Homo sapiens
  misc_feature: GYAE6OF02GQPO3.27.78.H01.1.454.CMB.1.raw
  modified_base (440)..(440): a, c, t, g, unknown or other
  misc_feature (440)..(440): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatacgcctaggaagctagaagatgctgacaacttattactgtcatcagtatacttactttacctntaagtgactctaccttcggaccaagggaccacgactagggactaagttaaaccgaacgtgtaggctaggcctaccacttccgtagttcc

SEQ ID NO: 171840 - DNA, 524 bp, Homo sapiens
  misc_feature: GYAE6OF02H5IY9.27.78.H01.1.454.CMB.1.raw
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagcaggtcagtctcaaagctcctcatcaagtatgctccagtccttctcgtacgggtccctcgaggttcagtcggcagtggatcgtgggactactactttcacccctcaccatacaatacgcctaggacgctagaagatgctgactattattactgtcatcagtagtactactttactatagtacgatcctaccgtcggacgaaggacacgacgtaggaataacgtaaacgtacgtgtacgctcgaccactatctcgtnttaccg

SEQ ID NO: 171841 - DNA, 541 bp, Homo sapiens
  misc_feature: GYAE6OF02JI2KO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtacccagcagaagccaggtcagtctccaaagctcctcatcaagtatgcttcccagtccttctcaggtcccctcgaggttcagtggcagtggatctgggacacatttccaccctcaccatcaatacgcctggaagctgaagatgctgcaacttattacctgtacatcagacgtacttactttacctactaaagtcgaattcaccttcggacccaaaggggtaccacgtactacgggagtaacgttaaacgaactggtacggacttacgaccaccctaatcttacgttcttacc

SEQ ID NO: 171842 - DNA, 497 bp, Homo sapiens
  misc_feature: GYAE6OF02FLGKZ.27.78.H01.1.454.CMB.1.raw
  modified_base (430)..(430): a, c, t, g, unknown or other
  misc_feature (430)..(430): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtgatctgggacacattcaccctcaccatcaatagcctggaagctgaagatgctgcaacttattactgtcatcagagtactactttaccnaagtgattcaccttcggcctaagggacacgactggaagattaaacgactgtagctgccacatctgtc

SEQ ID NO: 171843 - DNA, 592 bp, Homo sapiens
  misc_feature: GYAE6OF02JWJ1U.27.78.H01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggttctgctgctctgggttccagcctccaggggtnaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagttcccttctcgacggggttccccctacggaggtttccaggtggctaggttggactcgtagggacacgtactttcaccccgtnacccattcaaatacgaccctgggaaacncgtagaagactgctcgactaacttattactgttaccaatcaagtacgttaacttacctttactacgtaaggttctactacctaacccgttcggaacccgaacggggaacctaaccgacgtacgggtaagtaaccgttaaaaccgg

SEQ ID NO: 171844 - DNA, 610 bp, Homo sapiens
  misc_feature: GYAE6OF02F6XJM.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgccttcccagtccttctcacgggtcccctggagttcagtcggcagtggatcgtgggacactactttccaccctcaccatacaatacgcctaggaacgctaggaagtatgctgactaaactttattactgtactatcaagtacgtaaccttaactttacctactaagttctactaccgtaccgtttaccggacccgtaaagggacctaaccggtacgttacgggaacgttaaacgtttaaaacccggaaacgttcgggtacggtaccgttacggaccctaacccgttacgttacctttcggttaccctttaacccg

SEQ ID NO: 171845 - DNA, 574 bp, Homo sapiens
  misc_feature: GYAE6OF02H55IQ.27.78.H01.1.454.CMB.1.raw
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggngaaagtcaccatcacctgccgggccagtcagagcgttggtagtagcttacactggtaccagcagaacgccaggtcagctccaaagctcctcatcaagtangcttccagtcccttctcgacgggtccctcggacggttcacgtggcaggtggagtcgtacgggactacgtactttccaccctcaacctatacaatacgcctaggaacgtctaagaagtagtcgctgtactaatttattactgtactatcgagtacgttacttactttacctactaacgtcgtacttacgtacccgtttacggaccgtaacggtacgaacgtaccgtaggacgtaagttaaaaccgg

SEQ ID NO: 171846 - DNA, 552 bp, Homo sapiens
  misc_feature: GYAE6OF02GD495.27.78.H01.1.454.CMB.1.raw
  modified_base (195)..(195): a, c, t, g, unknown or other
  misc_feature (195)..(195): n is a, c, g, or t
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggcagtcagagcgttggtagtagcttacactggtaccagcagaagccaggtcagtctccaaagctcctcatcaagtatgcttcccagtccttctcgacgggtcccctgaggttcagtggcagtgatcgnggacactatttccaccctcaccatacaatacgcctaggaacnctagaagatgctgctaacttattactgtacatcagtagttaaccttactttaccataagtgacttcctaccgttccggaccaaagggaccacggactaggaacgtaagttaaaccgaacgttggtacggtccttagacctaaccctagttccttagtccttaccg

SEQ ID NO: 171847 - DNA, 581 bp, Homo sapiens
  misc_feature: GYAE6OF02HR8BL.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcaggtggatcgtgggacacgtactttccacccttcaccctataccaaatacgccgttagggaagctaggaaagattcggcttgacctaaacttattaacttgtcaatcagtacgttacttacctttaccactaagtgacttctaccttcggaccgaagggaccacggactaggggaaactaacgttaaaacgaaccgttaggtcggtacctacggaccctaacccgtattccttggttaccc

SEQ ID NO: 171848 - DNA, 511 bp, Homo sapiens
  misc_feature: GYAE6OF02HQRNP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctctcatcaagtatgctcccagtccttctcacgggtcccctgaggttcagtggcagtgatcgtggacacatttcaccctcaccatcaatcgctagagctgaagatgctgcaacttattactgtcatcagtagtacttactttacctactaagtgactcaccttcggaccaagggacacgacgtaggagtaataaacgactgtcggactcggacacctatcttcgtacttacc

SEQ ID NO: 171849 - DNA, 729 bp, Homo sapiens
  misc_feature: GYAE6OF02I7GJ7.27.78.H01.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
tcagagcgtcgtctcacgaccggtgctcgatttagtgtgagtagtttgggtttgggggcatgagcaaaactgacaagtcaaggcaggagatgttgccatcacaactcattgggttctgctagctctgggttccagcctccagggtnaattgtgctgactcagtctccagactttcagtctgtgactccaaaggnaagtcaccatcacctgccgggccaggtcagagcgttggtagtagcttacacgtggtaccagcagagccaggtcagtctccaaagctcctnactcaagtatcgcttcccaggttcccttcacgtacgggtcccctgtacggttccaggttcggctaggtcggtaactccgtacgggacctacgtactttccgacccttcaacccgtataccgaacgttacgacccgttacgggaaacgttccggtacggaacgtacgttacgaccgttacggtaaccctaaacgttttacgttaaccgtacggttaccgtaacgttaccgtaacgggtaacggtttaacccgttaaccgttttaacccgttaccgtaaacgggtttcgtaaccgtttcccgttaaacctttccggggaaccctaaacggggtacccttaccgggtaaccgttacgggtaacgtaaccgtttaaaccggaacgtttcgggttaccggtacgttccgggtaccgttacccggttaagttacccggtttagttaacccg

SEQ ID NO: 171850 - DNA, 549 bp, Homo sapiens
  misc_feature: GYAE6OF02GDPIR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacggggttcccctcggaggttcagtggcaggtggatcgtgggacactactttccaccctcaccatacaatacgcctaggaacgctagaagatgctgactaacttattactgtactatcagtactacttactttaccactaagtctactcctaccgttccggacctaagggaccacgacgtaggaagtaacttaaacgacgtggtacgcgtacgacctactctcgtcttcttacc

SEQ ID NO: 171851 - DNA, 502 bp, Homo sapiens
  misc_feature: GYAE6OF02J001U.27.78.H01.1.454.CMB.1.raw
  modified_base (196)..(196): a, c, t, g, unknown or other
  misc_feature (196)..(196): n is a, c, g, or t
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaagtcaccatcacctgccgggccagtcagagcgttggtagtagcttacactggtaccagcagaagccaggtcagtctccaaagctcctcatcaagtatgcttcccagtccttctcacggggtcccctcgacggttcagtgcagtgatctggacacatttcaccctcaccatcaatacgcctgganctgaagatgctgcaattatactgtcatcagatactacttacctcagtgactctaccttcggaccaaggacacgactggacgaataaactactagtcggctacgacactatcttcgtcttac

SEQ ID NO: 171852 - DNA, 526 bp, Homo sapiens
  misc_feature: GYAE6OF02FQ1BA.27.78.H01.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtntgcttcccagtccttctcacggggtcccctcggaggttcagtggcagtggatctgggacacatttcaccctcacatcaatagcctggaagctagaagatgctgactaacttattactgtctatcagacgtactactttaccnctaagtnactcaccgttcggaccaagggacacgtactaggagtaacttaaaccgaactggtacggctacgaccacctatctagtcttacc

SEQ ID NO: 171853 - DNA, 700 bp, Homo sapiens
  misc_feature: GYAE6OF02HOBEL.27.78.H01.1.454.CMB.1.raw
  modified_base (512)..(512): a, c, t, g, unknown or other
  misc_feature (512)..(512): n is a, c, g, or t
  modified_base (550)..(550): a, c, t, g, unknown or other
  misc_feature (550)..(550): n is a, c, g, or t
tcagagcgtcgtctcacgaccggtgctcgatttagtgtgagtagtttgggtttgggggatgagcaaaactgacaagtcaaggcaggaagatgttggccatcacaactcattgggtttctgctgctctgggttccagcctccaggggtgaaattgtgctgactcagtctccagtactttcagtctgttgactccaaaggagtaaagtcaccatccaccgtacgggccgacgtacgtacgaggacggttcgggttagggtagtacgttacgtactcggttaccgacggcaacggaagaccgtacggtacgtacgtactacctaaacgacctcctacctactactaacgttaagtcgtaccttcccctacggttccttccgttccgtaccgggggttccccggtccgtacggttacgtacggtagggtcgaggtaggtgtcgtcgggtaccgactacgtttcacccgttccaccgtactactaataacgtccgtacgggaaagtctagggaaagntacggcttaggactaacctttaattaccttcgtactanaccgtaagacgtttaacccttaacctttacaacgaatcgtactcctaaccgttcgggtacccaaaggtaccgacgacgttagggaataacgttaaaccgaggttggtacggccgtacgtctaacccgtatttcgtcgttccttaccgtac

SEQ ID NO: 171854 - DNA, 560 bp, Homo sapiens
  misc_feature: GYAE6OF02HWJ1W.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcgagggtcccctgaggttcaggtggcagtggatcgtgggacactatttccacccttcacccatcaatacgccctaggaagctaggaaagtatgctaggactaaactttattactgtacataccaagtagtacttactttaccactaagtgaactcctaccgttccggactaaacgggaccacgacgtgggaacgtaacgttaaacggaactggtacggacttcgactaccgtacgttctcgtccttaccg

SEQ ID NO: 171855 - DNA, 537 bp, Homo sapiens
  misc_feature: GYAE6OF02IH4I7.27.78.H01.1.454.CMB.1.raw
  modified_base (517)..(517): a, c, t, g, unknown or other
  misc_feature (517)..(517): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggccagtcagagcgttggtagtagcttacactggtaccagcagaagccaggtcagtctccaaagctcctcatcaagtatgccttcccagtccttctcacggggtcccctgaggttcagtggcagtggatcgtgggacactatttccaccctcaccatcaatacgcctggaacgctagaagatgctgactaacttattacttgtactatacagtaacgttaacttactttacctataagtgaacttccacccgtttcggacccgtaaagggaccacggacgtggaagtaattaaacgacttgnggctgacaccatctgtctac

SEQ ID NO: 171856 - DNA, 529 bp, Homo sapiens
  misc_feature: GYAE6OF02JKQCA.27.78.H01.1.454.CMB.1.raw
  modified_base (294)..(294): a, c, t, g, unknown or other
  misc_feature (294)..(294): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtntgcttcccagtccttctcacggggtcccctgaggttcagtggcagtggatcgtgggacacatttcaccctcaccatcaatgcctggaagctagaanatgctagactaactttatacttgtcaattcaagtacttacttacttttaccactaagttcgaatctaccgttcggacctaaagggaccacgatggagtacttaaacgactggtcgtactgaccactatcgttgtacttc

SEQ ID NO: 171857 - DNA, 582 bp, Homo sapiens
  misc_feature: GYAE6OF02I8P94.27.78.H01.1.454.CMB.1.raw
  modified_base (416)..(416): a, c, t, g, unknown or other
  misc_feature (416)..(416): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (570)..(570): a, c, t, g, unknown or other
  misc_feature (570)..(570): n is a, c, g, or t
tcagagcgtcgtctcacgaccggtgctcgatttagtgtgagtagtttgggttgggggcatgagcaaaactgacaagtcaaggcaggaagatgttgccatcacaactcattggttctgctgctctgggttccagccgtccaggggtgaaattgtgctgactcagtctccagactttcagtctgtgactccaaaggagaaagtcaccatcacctgccgggccagtcagagcgttggtagtagcttacactggtaccagcagaagccaggtcagtcctaccaaagcctcctcatcaagtatcgtccttcccagtcccttctccgtacgggggttccccctcggtaggtttccaggtcggcgtagtggactccgtgggacactactttccaccctcaccactcaatacgccgtaggaacnctagaagatgctgactaacttattactgtctagtactagtagtaaccttactttacctntaacgttntacttccgtaaccgttccggaccgtaacgggacctaccggagtcggaacgtaaacttaaacggaacttggaggtctcgaccaacctnttccgtgttacc

SEQ ID NO: 171858 - DNA, 682 bp, Homo sapiens
  misc_feature: GYAE6OF02FEQ5J.27.78.H01.1.454.CMB.1.raw
  modified_base (179)..(179): a, c, t, g, unknown or other
  misc_feature (179)..(179): n is a, c, g, or t
  modified_base (584)..(584): a, c, t, g, unknown or other
  misc_feature (584)..(584): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactctattgggttctgctgctcgtgggttccagcctcgagggtnaattgtgctgactcacgttcctccagtactttcagttctgtacgactaccgaaaggacgaaacgtccaccatccaccgtcggccggcagtcagagtcgttggtagtacgtacttacgacgttacggtaaccaggacaaggaacgccgtacggtacctaacggttacctaacccgaaacgtccttaccctactaacgtacgtaacgttacgtccgtaccttcccgtacgttccttccgtacggtacccggggttcccaggtacggttcgaggtcggcgtaggtcggtactcggtacgtacctacgtactttacccacccgtacaacgacttaaccgaacgtaccgaccgttaggaacgtactaggaacgtgtacgtcgtactaactacgtttactactagtactanaccgttaataccgttaccttacttaccatacgtaactacctacccgtaccgttacggaacgaacggtactaaccggacgtacgtaagttactaacggg

SEQ ID NO: 171859 - DNA, 592 bp, Homo sapiens
  misc_feature: GYAE6OF02HBPGA.27.78.H01.1.454.CMB.1.raw
  modified_base (506)..(506): a, c, t, g, unknown or other
  misc_feature (506)..(506): n is a, c, g, or t
tcagagcgtcgtctcacgaccggtgctcgatttagtgtgagtagtttgggtttgggggggcatgagacaaaactgacaagtcaaggcaggaagatgttgccatcacaactcattgggtttctgctgctcgtgggttccagcctccgaggggtagaaattgtgctgactcagtctccagtactttcagtctgtgactaccaaaggagaaagtcaccatcacctcggccgggccagtcagagtcgttggtagtagcttacacgtcggtaccagcagaagccaggtcacgtctaccaaagcctcctcatacaagtatcgtccttccctacgttccttcgtccgtaccggggttcccctacggtacggttacaggtcggcgtaggtggtagtcgtagggactactactttaccaccctaccacctatacaatacgccgtaggaacgcgtaagagatgctagacctaacttattactgtacatcagtacttaccttacttacctataagtntactcctaccgtcggaccgaagggaccacgtacgtaggaactaagttaaacgacgtgtacgtctacgacctacgtactctgttacc

SEQ ID NO: 171860 - DNA, 604 bp, Homo sapiens
  misc_feature: GYAE6OF02HY2IP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggcagtcagagcgttggtagtagcttacactggtaccagcagaagccaggtcagtctccaaagctcctcatcaagtatgcttcccagttccttctcgacgggtcccctcgaggttcagtggcagtggatcgtgggactaactactttccacccctcaacccatacaaatacgcccgtagggaacgtcgtagaaagattagcttagactaactttatttaacttgtactatacaagtaagttaaccttaacctttaaccctactaagttcgtaacttacctaaccgtttcggaaccgtaagggacccacggtacgtaggaaggtaaactttaaaccggaacgttggtacggtcgtggacctacctaacgttacttcgttcctttaacc

SEQ ID NO: 171861 - DNA, 548 bp, Homo sapiens
  misc_feature: GYAE6OF02IZ3T1.27.78.H01.1.454.CMB.1.raw
  modified_base (228)..(228): a, c, t, g, unknown or other
  misc_feature (228)..(228): n is a, c, g, or t
  modified_base (414)..(414): a, c, t, g, unknown or other
  misc_feature (414)..(414): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagactttcagtctgtgactccaaagganaaagtcaccatcacctgccggccagtcagagcgttggtagtagcttacactggtaccagcagaagccaggtcagtctccaaagctcctcactcaagtatgcttcccagtccttctcacgggtcccctgaggttcagtgcagtggatctgggacacatttcaccctcaccatcaatacgcctggaanctagaagatgctgactaactttattactgtacattacagtaagtactactttacctactaagtcgtaactcctaccgtttaccggaccgtaaacgggtacaccggaacgtacgggtaagtaacgttaaaaccgg

SEQ ID NO: 171862 - DNA, 594 bp, Homo sapiens
  misc_feature: GYAE6OF02JXLW1.27.78.H01.1.454.CMB.1.raw
tcagagcgtcgtctcacgaccggtgctcgatttagtgtgagtagtttgggtttggggggtcgatgagcaaaactagacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagctttacactggtaccagcagaagccaggtcagtctccaaagctcctcatcaagtatcgcttcccagtccttctcacggggtcccctcgaggttcagtggcagtggatcgtgggacactatttccacccttcacccatccaagtacgcgtacggaagcttacggaagtatggactggactaaacgtttattactgtacatcagtacgtacttactttaccctactaagtagtattacctaccgttacggacctaaacggggaccaccgtaacgtacggaacggtaaacgttaaacgaaccgtaggttccggacgttacgacccgttaacacgtttctacggtttaccc

SEQ ID NO: 171863 - DNA, 501 bp, Homo sapiens
  misc_feature: GYAE6OF02GW27A.27.78.H01.1.454.CMB.1.raw
  modified_base (392)..(392): a, c, t, g, unknown or other
  misc_feature (392)..(392): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagntgctgcaacttattactgtcatcagatactacttactcaagtgatcaccgttcgaccaagggactacgataggagtaattaaacgactaggtgctggcaccatctgtcc

SEQ ID NO: 171864 - DNA, 545 bp, Homo sapiens
  misc_feature: GYAE6OF02JTZ8G.27.78.H01.1.454.CMB.1.raw
  modified_base (227)..(227): a, c, t, g, unknown or other
  misc_feature (227)..(227): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactcaaaggnaagtcaccatcactgccggccagtcagagcgttggtagtagcttacactggtaccagcagaagccaggtcagtctccaaagctcctcatccaagtatgccttcccagttcccttcgtcacggggtcccctgtacgttcagtgcaggtggatcgtgggactacatttccaccctcaccatacaatacgcctaggaacgtctgaagatcgcgtagacctaactttactactgtacatcagtagtacttacttacctntaagtgaacttctaacccgttcggacctaacgggacctacgacgtaggactaacgttaaaccg

SEQ ID NO: 171865 - DNA, 502 bp, Homo sapiens
  misc_feature: GYAE6OF02F9EH7.27.78.H01.1.454.CMB.1.raw
  modified_base (196)..(196): a, c, t, g, unknown or other
  misc_feature (196)..(196): n is a, c, g, or t
  modified_base (385)..(385): a, c, t, g, unknown or other
  misc_feature (385)..(385): n is a, c, g, or t
  modified_base (493)..(493): a, c, t, g, unknown or other
  misc_feature (493)..(493): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcacccatcaatagcctggaanctgaagatgctgcaacttattactgtcatcagtagtactacttacctactagtcatcacttcggaccaaggacacgtactggaacgtataaacgactgtgctgcaccntctgtctac

SEQ ID NO: 171866 - DNA, 508 bp, Homo sapiens
  misc_feature: GYAE6OF02GLKRJ.27.78.H01.1.454.CMB.1.raw
  modified_base (228)..(228): a, c, t, g, unknown or other
  misc_feature (228)..(228): n is a, c, g, or t
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctgaggttcagtgcagtggatctgggacacatttcacccctcaccatcaatagcctggaagctgaagatgctgctaacttattactgtcatcagtagtactactttactacaagtnatcaccttcggaccaaggacacgactggagattaaacg

SEQ ID NO: 171867 - DNA, 597 bp, Homo sapiens
  misc_feature: GYAE6OF02INNOO.27.78.H01.1.454.CMB.1.raw
  modified_base (204)..(204): a, c, t, g, unknown or other
  misc_feature (204)..(204): n is a, c, g, or t
tcagagcgtcgtctcacgaccggtgctcgatttagtgtgagtagtttgggtttggggggatgagcaaaactgacaagtcaaggcacggaagatgttgccctatcacaactcattgggtttctggctgcctctggttccagcctccaggggtgaaattcgtgctgactcagtcctccagactttacagtctgtgactccaaaggngaaagtcaccatccacctgccgggccaagtcagagcgttgggtagtagcttacactcggtaccagccagaagcccaggtcagtctccaaagctacctcatcaacgtatgcttcccagtcccttactcacgggtcccctcgtacggttcagtggcagtggatctcggacactatttcaccctcaccatacaagtacgccgtggaatctagaagagtagctggctaacttattacttgtctatcgaagtagtacttacgtttacctacgtaacgtagacttcgacccgttttccggaccgaaacgggacctaaccggacgtcgggtaacggtaactttaaaccggaacttcggtacggtaccgttcgaccctacctactccttcgttccttaccg

SEQ ID NO: 171868 - DNA, 556 bp, Homo sapiens
  misc_feature: GYAE6OF02GKTZK.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgccttcccagtccttctcgacggggtcccctcgaggttcagtggcaggtggatcgtgggacactatttccaccctcaccatacaatacgcctaggaagctagaagtatgctgactaacttattactgtcatcagtacgttactactttacctactaagtgtacttcctacccgtttcggaccgaaacgggaccacggacgtaggaagtaacgttaaacgaactggtacggcgtacgacaaccctatccttcgttccttaccg

SEQ ID NO: 171869 - DNA, 531 bp, Homo sapiens
  misc_feature: GYAE6OF02FQWNY.27.78.H01.1.454.CMB.1.raw
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacgatttccaccccttcacccatcaatgcctggaagctagaagatgctgactaacttattactgtcatcagagttactactttaccanaagtgatcaccgttcggaccaagggaccacggacgtaggaacgtaacttaaacgaactaggtcgtctgaccacctagtccttagtcttaccg

SEQ ID NO: 171870 - DNA, 547 bp, Homo sapiens
  misc_feature: GYAE6OF02HI9QA.27.78.H01.1.454.CMB.1.raw
  modified_base (408)..(408): a, c, t, g, unknown or other
  misc_feature (408)..(408): n is a, c, g, or t
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgccttcccagttcccttctcgacgggggtcccctcggacggttccaggtggcagtggatcgtgggacactattccaccctcaccatcaatcgcctggaacgctagaagntgctgactaacttattactgtcatcatacgttacttacctttaccactaagtnacttcctaaccgttcggaccaagggaccacggactaggaacgtattaaaccgactacggtaggactcgccaacctatccgtgtacc

SEQ ID NO: 171871 - DNA, 621 bp, Homo sapiens
  misc_feature: GYAE6OF02GR9PH.27.78.H01.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
tcagagcgtcgtctcacgaccggtgctcgatttagtgtgagtagtttgggtttggggatacttaaaagaggttctttctctgggatgtggcatgagcaaaactgacaagtcaaggcaggaagatgttgccatcacaactcattgggtttctgctgctctggtacnggctcgaggtagaatgntgnactnagtctcagacttnagtctagtnactcaagagaatcacatcacctgccggcagtcagngcgttgagtagcttacacttggaccagcagagccgaggtccaggtcaccaagtctaccatatcaaagtactgtccttacccgngttccctacgtaccggtaccgggtccctaggtacggttcagtcggacgtggtacgtactacggtacgactactacgttaccacctacactactactaacgtacgaccgtaggaacgtacgtagtaagacgtctcgtataccgttaacttacgttacgttcgtactagttacgtacgtaacttaccgttactttaccgacgttaacgttcgtaaccttaccggttaccgttacccggtaacgtaacggttaaccggtaacggtaccggtaacggtaaccggtaacgttaacgg

SEQ ID NO: 171872 - DNA, 495 bp, Homo sapiens
  misc_feature: GYAE6OF02GXRPF.27.78.H01.1.454.CMB.1.raw
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgctaacttattactgtcatcagattactactttacctcaagtgatcaccttcggccaaggcacgactggaanattaacgatcgtgctgccacatctntc

SEQ ID NO: 171873 - DNA, 508 bp, Homo sapiens
  misc_feature: GYAE6OF02HQTKQ.27.78.H01.1.454.CMB.1.raw
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcagggtcccctcgaggttcagtggcagtggatctgggacacgatttcaccctcaccatcaatagcctggaagctagaagatgctgcaactttattactgtcatcagagtacttactttacctanaagtgatcaccttcggaccaagggacacgacgtggagaattaaacgactgtaggctcgcacctatctgtcttac

SEQ ID NO: 171874 - DNA, 505 bp, Homo sapiens
  misc_feature: GYAE6OF02GZ35P.27.78.H01.1.454.CMB.1.raw
  modified_base (434)..(434): a, c, t, g, unknown or other
  misc_feature (434)..(434): n is a, c, g, or t
  modified_base (500)..(500): a, c, t, g, unknown or other
  misc_feature (500)..(500): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatacgctaggaagctgaagatgctgcaacttattacttgtcatcagtagtactactttacctanaagtgatcaccttcggccaaagggacacgactggagattaaacgatgtggctcgcaccatctcgtnttacc

SEQ ID NO: 171875 - DNA, 492 bp, Homo sapiens
  misc_feature: GYAE6OF02INQHO.27.78.H01.1.454.CMB.1.raw
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtgatctgggacacatttcaccctcaccatcaatacgcctaggaagctagaagatgctgactaacttattactgtcatcagatactactttacctnaagtgatcacctcgaccaaggcacgatgganataacgatgngctgcacatctntc

SEQ ID NO: 171876 - DNA, 492 bp, Homo sapiens
  misc_feature: GYAE6OF02FRAND.27.78.H01.1.454.CMB.1.raw
  modified_base (195)..(195): a, c, t, g, unknown or other
  misc_feature (195)..(195): n is a, c, g, or t
  modified_base (431)..(431): a, c, t, g, unknown or other
  misc_feature (431)..(431): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctagaagatgctgctaacttattactgtacatcagatactactttaccntaagtgatcaccttcgccaaggacagctggagaataacgatgtagntgcacatctgtcttc

SEQ ID NO: 171877 - DNA, 533 bp, Homo sapiens
  misc_feature: GYAE6OF02HSPX1.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatctgggacacatttcaccctcaccatcaatacgcctggaacgctagaagatgctgcaacttattactgtcattcaagtagtactactttacctactaagtgaatcaaccgtttcggaccaagggacacgacgtggaagtaattaaaccgaacttgtacggctacgacgtacccattcgtagtccttaccg

SEQ ID NO: 171878 - DNA, 518 bp, Homo sapiens
  misc_feature: GYAE6OF02HPHK2.27.78.H01.1.454.CMB.1.raw
  modified_base (469)..(469): a, c, t, g, unknown or other
  misc_feature (469)..(469): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtcctctcacgggtccctcgagttcagtgcagtggatcgtgggacacatttccaccctcaccatcaatagcctggacgctgaagatgctgctaacttatactgtcatacagacgtacttacttactactaagtnactacaccgttaccggaccgaacggacacgacgtaggacgtattaaacg

SEQ ID NO: 171879 - DNA, 539 bp, Homo sapiens
  misc_feature: GYAE6OF02I4WVE.27.78.H01.1.454.CMB.1.raw
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagtcccttctcacggggtcccctgaggttcagtggcagtggatcgtgggacactatttcaccctcaccatcaatcgcctggaagctagaagatgctgctaacttattaactgtacatcagtagtacttactttacctataacgttnactactaccgttacggaccgtaacgggaccaccggacgtcggacgtattaaaaccgg

SEQ ID NO: 171880 - DNA, 524 bp, Homo sapiens
  misc_feature: GYAE6OF02IG5EP.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctacagtgattcaccttcggaccaaagggacaccggactagggagtaacttaaacggaactaggtcggtacgtgcctaccgtatcttagtcttaccg

SEQ ID NO: 171881 - DNA, 518 bp, Homo sapiens
  misc_feature: GYAE6OF02IBJVX.27.78.H01.1.454.CMB.1.raw
  modified_base (196)..(196): a, c, t, g, unknown or other
  misc_feature (196)..(196): n is a, c, g, or t
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgagacacatttcaccctcaccatcaatacgctggaanctgaagatgctgcaaacttattactgtacatcagtagtacttacttttaccnctaagtgatcctaccttcggaccaagggacacgactagggactaagttaaacgaactgtaggctcggccaccattctagttcc

SEQ ID NO: 171882 - DNA, 533 bp, Homo sapiens
  misc_feature: GYAE6OF02GLM0P.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgactaacttattactgtcatcagtagtactactttacctactaagtgatccaccgttccggaccgaaagggacacggactggaacgtaacttaaaccggaacgtgtaggacctagaccacctatccttgtacttaccg

SEQ ID NO: 171883 - DNA, 531 bp, Homo sapiens
  misc_feature: GYAE6OF02H55LQ.27.78.H01.1.454.CMB.1.raw
  modified_base (229)..(229): a, c, t, g, unknown or other
  misc_feature (229)..(229): n is a, c, g, or t
  modified_base (448)..(448): a, c, t, g, unknown or other
  misc_feature (448)..(448): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggngaaagtcaccatcacctgccgggccagtcagagcgttggtagtagcttacactggtaccagcagaagccaggtcagtctccaaagctcctcatcaagtatgcttcccagtcccttctcacggggtcccctcgaggttcagtggcagtggatcgtgggacacatttccaccctcaccatcaatagcctaggaagctagaagatgctgctaacttattacngtcatcagagttactactttacctctaagtgactctaccgttcggaccgaacgggacaaccgacgtaggacgtaataaaccgg

SEQ ID NO: 171884 - DNA, 548 bp, Homo sapiens
  misc_feature: GYAE6OF02G50AF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcaggtggcagtggatctgggacacatttccaccctcaccatcaatacgcctaggaagctagaagatgctgactaacttattactgtcatcagtagtacttactttacctctaagtgtatctaccttcggaccaaagggaccaacggactagggaacgtaacgttaaaaccgacgtagtacggtactacggaccaccgtagtccttgtaccttaccg

SEQ ID NO: 171885 - DNA, 516 bp, Homo sapiens
  misc_feature: GYAE6OF02GKP58.27.78.H01.1.454.CMB.1.raw
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgacggttcagtggcagtggatcgtgggacactatttccaccctcaccatcaatagcctaggaanctagaagatgctgactaacttattactgtcattcagtatacttactttacctacaagtgatcaccttcggaccaagggaccagactggagtaacttaaacgaactgtgctgacctaccatcttgtcttc

SEQ ID NO: 171886 - DNA, 527 bp, Homo sapiens
  misc_feature: GYAE6OF02GT1T3.27.78.H01.1.454.CMB.1.raw
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcagggtcccctgaggttcagtggcagtggatctgggacacatttcacctcaccatcaatagcctggaagctgaagatgctgacaacttatactgtcatcagatactactttactcaagtnatcaccttcggaccaagggacacgtacgtaggaacgtaattaaaccggaactggtacggtccttacggacctaaccgagttccgttgttccttaccg

SEQ ID NO: 171887 - DNA, 524 bp, Homo sapiens
  misc_feature: GYAE6OF02F7KS8.27.78.H01.1.454.CMB.1.raw
  modified_base (479)..(479): a, c, t, g, unknown or other
  misc_feature (479)..(479): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcaggtgcagtggatcgtgggacacatttcaccctcaccatacaatacgcctaggaagctagaagatgctgactaacttattactgtcatcagactactactttactctaagtntactctaccgttcgaccgtaaggacacgactacggatataaaccg

SEQ ID NO: 171888 - DNA, 514 bp, Homo sapiens
  misc_feature: GYAE6OF02F5GRR.27.78.H01.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggttaaattgtgctgactcagtctccagactttcagtctgtgactccaaagganaaagtcaccatcacctgccgggcagtcagagcgttggtagtagcttacactggtaccagcagaagccaggtcagtctccaaagctcctcatcaagtatgcttccagtcctntcagggtccctgaggttcagtggcagtggatcgtgggacacatttcaccctcacccatcaatacgcctggaacgctagaagactgctgctaacttatactgtcatcagtatactactttacnctaagtgtatcaccgtcgaccgaagggtacacgactggagattaacgtaacg

SEQ ID NO: 171889 - DNA, 590 bp, Homo sapiens
  misc_feature: GYAE6OF02FZLIV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaactacgcctaggaagctagaagatgctgactaacttattactgtcatcaagtacgttaacttacgtttaacctactaagttacgacttaccgtacccgttccgggacccaaaggggtaaccaaccgggtacgtacgggaacgttaacgttaaaaccggtaaccgttaggtacgggtacgtacggacctaacccgtagtccgttacgtccctttaccg

SEQ ID NO: 171890 - DNA, 517 bp, Homo sapiens
  misc_feature: GYAE6OF02G4J5J.27.78.H01.1.454.CMB.1.raw
  modified_base (513)..(513): a, c, t, g, unknown or other
  misc_feature (513)..(513): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcaggtggatcgtgggacacgtatttcacccctcaccatcaatagcctaggaagctagaagatgctgactaacttattactgtcatcatacgtactactttacctcaagtcatcaccttcggaccaggaccacgactaggaagtaactaacgactgtagctcgacacctatctnttcc

SEQ ID NO: 171891 - DNA, 581 bp, Homo sapiens
  misc_feature: GYAE6OF02IX6RE.27.78.H01.1.454.CMB.1.raw
  modified_base (249)..(249): a, c, t, g, unknown or other
  misc_feature (249)..(249): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacnctggtaccagcagagccaggtcagtctccaaagctcctcatcaagtatgcttccagtccttctcacgggttcccctcgaggttcagtgcagtcggatcgtgggacacgtatttcaccctcaccatcaatacgcctggaacnctagaagatgctgctaacttattactacgtctactacagtacgttaccttactttaacctacgtaagttacgtacttacccgtaccgttccggaacccgtaagggaacctaccggacgttagggacgtaaacgttaaaccgtaacgtggtacggtacgtacgtaccgtaaccgtacttccgtagttacccg

SEQ ID NO: 171892 - DNA, 491 bp, Homo sapiens
  misc_feature: GYAE6OF02ITL5L.27.78.H01.1.454.CMB.1.raw
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatcgtgggacacatttcaccctcaccatcaatagcctggaagctagaagatgctgctaacttattactgtacatcagagtactacttaccnaagtgatcactcgacaggacacgatgganaataaacgactgtgctncacatctgtc

SEQ ID NO: 171893 - DNA, 718 bp, Homo sapiens
  misc_feature: GYAE6OF02J3LQX.27.78.H01.1.454.CMB.1.raw
  modified_base (120)..(120): a, c, t, g, unknown or other
  misc_feature (120)..(120): n is a, c, g, or t
  modified_base (125)..(125): a, c, t, g, unknown or other
  misc_feature (125)..(125): n is a, c, g, or t
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatcttaaagaggttctttctctgggatgtggcatgagacaaaactgacaagtcaaggcagagntgtcncatcactactgtagttggttcngctcgtctcgttcggtccacgtccgtacggtagggtataagtgtcgactacgacctcgtcgttcctacgtacttacttcgagttcgtacgtacgaaccgtaaccggaaaggtacctaactaccaccgaccgttacccgaccggtccgggccggtacacgtcgtagtcggtcggttagtacgtactaccgtacgacggtacgacgacgacacgtacgccgtagtctaccgactaccacgtcctacagtactacgtacgttcctaccgtcctttaccgccgttcgttaccgggtccgtaccggttcgtacgtacggtacgtcggtacgtcggtacgtcggtactaccggtaacctactaccgttaccctaccgaccactaactccgtaactacgtcggaactcggaagttcaaggtctctcgtactaacgttacttacttcgtacagtactaacggtcttaaacccttacttacgttaccctagtacgttaccgtcctccggtaaaccggcggtaaccggtaaacgtacccggtaggtaaccggttaacggtaacgttaacgtaccggttacg

SEQ ID NO: 171894 - DNA, 564 bp, Homo sapiens
  misc_feature: GYAE6OF02H43VY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgtccttcccagtccttctcgacggggtcccctcgaggttcaggtggcaggtggatcgtggacactatttcaccctcaccatacaatacgcctaggaagtctagaagatgctgactaactttattactgtcatcagatacttaactttacctactaagtgtactcctaccgttccggaccgtaaacgggaccaacgtacgtagggaacgtaaattaaaccggaacttaggtacggtacgtacgaccaacctacttcgtcgttccttacc

SEQ ID NO: 171895 - DNA, 544 bp, Homo sapiens
  misc_feature: GYAE6OF02HLU6Q.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgagttcagtggcagtggatcgtgggacactattcaccctcaccatacaatacgcctggaagctagaagatgctgactaactttattactgtcatcagtacgtactactttacctacaagtcattccaccgtttccggaccaacgggaccacgacgtggtaagtaattaaaccggaagttcggtacggacttcggaccaccgtagtccgttagtccttaaccg

SEQ ID NO: 171896 - DNA, 540 bp, Homo sapiens
  misc_feature: GYAE6OF02G7M6J.27.78.H01.1.454.CMB.1.raw
  modified_base (316)..(316): a, c, t, g, unknown or other
  misc_feature (316)..(316): n is a, c, g, or t
  modified_base (397)..(397): a, c, t, g, unknown or other
  misc_feature (397)..(397): n is a, c, g, or t
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagcgttggtagtagcttacactggtaccagcagaagccaggtcagtctaccaaagctcctcatacaagtatcgccttcccagtccttcncgtacgggtcccctgaggttcagtggcaggtggatcgtgggacacgactttccaccctcaccatacaatcgcctaggaacncgtagaagatcgctgactaaccttattactgtacatcaagtacgtacttactttactactaagtnacttcaccttcggaccaaggacacgactggacgtaattaacgaagtgtacgcgtcgccgacctactcgtcttcttacc

SEQ ID NO: 171897 - DNA, 620 bp, Homo sapiens
  misc_feature: GYAE6OF02J13AC.27.78.H01.1.454.CMB.1.raw
  modified_base (415)..(415): a, c, t, g, unknown or other
  misc_feature (415)..(415): n is a, c, g, or t
tcagagcgtcgtctcacgaccggtgctcgatttagtgtgagtagtttgggtttggggggcgatgagcaaaaactgacaagtcaaggcaggaagatgttgccatcacaactcattgggtttctgctgctctgggttccagcctcaggggtgaaattgtgctgactcagtctccagactttcagtctgtgactccaaaaggagaaagtcacatcacctggccgggccagtcagagcgttggtagtagcttacactggtaccagcagaacgcaggtcagtctcaaagctcctcatcaatatcgcttcccagttccttctcgacggggttcccctcgtacggttcaggtcggcgtaggtggactcgtaggggactacgtactttccaaccctcaccagtacaactacgcctaggaacgnttacggaaagctggactgacctaaacgttactttactgttacattcaagtacgttaacttaaccgtttacctacgtaaagtcgtactcctaaccgtttcggaaccgaaaggtaccaacggttcgtaacgggaacggtaaacgtttaaccggaaacgttcggtaacggtccttaacggaccctactacgttaccgttgtttacccg

SEQ ID NO: 171898 - DNA, 537 bp, Homo sapiens
  misc_feature: GYAE6OF02INCXO.27.78.H01.1.454.CMB.1.raw
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcaccatcaatacgcctaggaagctggaagntgctgacaacttattactgtcatcagtagtacttacttacctactaagtgactctaccgttcggaccaaacgggaccaacgacgtaggacgtaattaaaccgacgttggtacggactcgaccacctagtccttcgtacttacc

SEQ ID NO: 171899 - DNA, 745 bp, Homo sapiens
  misc_feature: GYAE6OF02J21GP.27.78.H01.1.454.CMB.1.raw
  modified_base (145)..(145): a, c, t, g, unknown or other
  misc_feature (145)..(145): n is a, c, g, or t
  modified_base (284)..(284): a, c, t, g, unknown or other
  misc_feature (284)..(284): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtnaaattgtgctgactcagtctccagactttcagtctgtgactccaaaggagaagtcaccatcacctgccgggccagtcagagcgttggtagtagcttacactggtaccagcagagccaggtcagtctccaaagcctcctnactcaagtatcgtccttccgacgtccttcgtaaccgtcgggtcccctcggtacggttcaggtcgcaggtggacttcggtagggacctacgtacgtttacccaccctacaccgtaactctaacgttacgcccgtagggaacgtcctaaggaagtacgtacggaccgttacgtaaccttaaaccgtttacgtttaaccgttacggttacctaacgttaccgtaacggttaaccgtttaacccgtttaaaccgttttacccgtaacgttaacggtttaccgttaaaccgtttaccccgttaacccgtttcccgggtaaaccgtaaaccgggggttaccctaaccggggtaacgttaaccgggtaacggttaaaaccggtttaaccggaaccgttacgggttccggtacctttaccgggaaccctaaaccgttcgtttaccgtttaccgttacccgtttacccgg

SEQ ID NO: 171900 - DNA, 509 bp, Homo sapiens
  misc_feature: GYAE6OF02F8YYK.27.78.H01.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctcgaggttcagtggcagtggatctggacacatttccacctcaccatcaatgcctggaagctagaagatgctgacaacttattactgtacatcagtactacttactttaccntaagtnactcaccgttcggaccaagggaccagacgtggaactaagtaaacgactgtcgctgactaccatctgtctac

SEQ ID NO: 171901 - DNA, 524 bp, Homo sapiens
  misc_feature: GYAE6OF02H3K4S.27.78.H01.1.454.CMB.1.raw
  modified_base (360)..(360): a, c, t, g, unknown or other
  misc_feature (360)..(360): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggagtagcttacactggtaccagcagacgcgagtcagtctccaaagctcctcatcaagtatgcttccagtccttctcacgggtccctgacggttcngtgcagtgatcgtggacacacgtttcaccctcaccatcaactgcctaggaacgctagaagatgctcgacaactttatactgtctatcagagttactacttacctactagtntacttcaaccgtttacgaccgtaggaccgacgtacgtggacgtattaaaccgg

SEQ ID NO: 171902 - DNA, 518 bp, Homo sapiens
  misc_feature: GYAE6OF02GS1WI.27.78.H01.1.454.CMB.1.raw
  modified_base (196)..(196): a, c, t, g, unknown or other
  misc_feature (196)..(196): n is a, c, g, or t
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatcgcttcccagtccttctcacggggtcccctcgaggttcagtggcagtgatctggacacatttcaccctcaccatcaatacgcctggaagctagaacgatgctagctaacttattactgtacatcagtagtacttactttaccataagtnatcaccttcggaccaagggacacgtactggaagtaattaaacgactgtacgntacgcacctatcttagtcttac

SEQ ID NO: 171903 - DNA, 497 bp, Homo sapiens
  misc_feature: GYAE6OF02FUIY7.27.78.H01.1.454.CMB.1.raw
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctagaagatgctgcaacttattactgtcatcagacgtactactttacctnaagtnatcaccttcggaccaaggacacganggagataaacgactgtagntgcacatctgtcttc

SEQ ID NO: 171904 - DNA, 570 bp, Homo sapiens
  misc_feature: GYAE6OF02G9K0H.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatccacctgccgggccagtcagagcgttggtagtagcttacactggtaccagcagaagccaggtcagtctaccaaagctcctcatcaagtatgcttcccagttccttctcgacggggtcccctcggtacggttcagtggcagtggatcgtgggacactatttcacccctcaccatacaatacgcctaggaacgctagaagatgctgactaacttattactgtctatacagtaacgttacttacctttacctactaagtcgtaacttcctaacccgttcggacccgtaacgggaccgaaccggtaccgtacggtacggtaacttaaaaccgg

SEQ ID NO: 171905 - DNA, 516 bp, Homo sapiens
  misc_feature: GYAE6OF02H1X82.27.78.H01.1.454.CMB.1.raw
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacactatttccaccctcaccatacaactagcctggaacgctagaagatgctgactaacttattactgtcatcagactacttactttacctataagtgtaatctaccttcggaccaacgggacacgactggaagaattaaacgactgagctgcaccntactgtctac

SEQ ID NO: 171906 - DNA, 508 bp, Homo sapiens
  misc_feature: GYAE6OF02G3JEZ.27.78.H01.1.454.CMB.1.raw
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcggttggtagtagcttacactggtaccagcagaagccaggtcagtctccaaagctcctcatcaagtatgcttcccagtccttctcacgggtcccctcgaggttcagtggcagtggatctgggacacgactttccaccctcacctatacaactagccctagggaacgcgtagaagagtcgctgactaacttattactgtcatcagtatactacttacctntagtgatctaccgtcgcaagggacagactggagaactaacgatgngcngcacntctntctc

SEQ ID NO: 171907 - DNA, 520 bp, Homo sapiens
  misc_feature: GYAE6OF02F7N41.27.78.H01.1.454.CMB.1.raw
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagttccttctcacggggtcccctcgaggttcagtggcagtgatcgtgggacacatttcaccctcaccatcaatacgcctaggacgctagaagtatgctgcaacttattactgtcatcagagttactactttacnctaagtntactcaccttcggccaagggacacgactaggataacttaacgaacttgtggtctcggaccacctatctgttcc

SEQ ID NO: 171908 - DNA, 505 bp, Homo sapiens
  misc_feature: GYAE6OF02HWBTY.27.78.H01.1.454.CMB.1.raw
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtgcagtggatctgggacacatttcaccctcaccatcaatagcctggaagctagaagatgctgctaacttattactgtcatcagactactactttacctnaagtnatcaccttcgaccaagggacacgactggagataaacg

SEQ ID NO: 171909 - DNA, 532 bp, Homo sapiens
  misc_feature: GYAE6OF02F724V.27.78.H01.1.454.CMB.1.raw
  modified_base (443)..(443): a, c, t, g, unknown or other
  misc_feature (443)..(443): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacgtatttccaccctcaccatcaatagcctaggaagctagaagatgctgactaacttattactgtcatcagtatactactttaccntaagtgactccaccttcggaccaagggaccacgacgtaggaagtaacttaaacggaactggtaggctcgaccacctattcgtcgttacc

SEQ ID NO: 171910 - DNA, 610 bp, Homo sapiens
  misc_feature: GYAE6OF02IF0S8.27.78.H01.1.454.CMB.1.raw
  modified_base (401)..(401): a, c, t, g, unknown or other
  misc_feature (401)..(401): n is a, c, g, or t
tcagagcgtcgtctcacgaccggtgctcgatttagtgtgagtagtttgggtttgggggggtcgatgagcaaaactgacaagtcaaggcaggaagatgttggcccatcacaactcattggggtttctgctgctctggggttccagcctccaggggtgaaattgtgctgactcagtctccagactttcagtctgtcgactccaaaggagaaagtcaccatcacctgccgggccagtcagagtcgttggtagtacgcttacactggtaccagcagaagcctaaggtcagtctacaaagctacctacatcaagtatcgccttcccagttccttctcgacggggtcccctacgaggttctaggtggcgagtggtatcgtagggacacgtatttccaccctcaaccntacgaatacgccttaggtaacgcttaggaaacgtctgcctaggactaaactttattacgtgtacaatcgtaagtaacttacttaaccttttaccacgtaagttcgtaactcctaaccgttacggacccgtaacgggtacccacggtacgtagggaaactaataaacggtaactaggtacggactacgacctaccacgttcctagttacc

SEQ ID NO: 171911 - DNA, 541 bp, Homo sapiens
  misc_feature: GYAE6OF02HUWKJ.27.78.H01.1.454.CMB.1.raw
  modified_base (229)..(229): a, c, t, g, unknown or other
  misc_feature (229)..(229): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggnaaagtcaccatcacctgccgggcagtcagagcgttggtagtagcttacactggtaccagcagaagccaggtcagtctccaaagctcctcatcaagtatgtcttcccagtcccttctcacggggtcccctgaggttcagtgcagtgatctgggacacatttccaccctcaccatcaaatagcctaggaacgtctagaagatgctgacctaacttattactgtctaatcaagagttacctacttttaccnctaagtcgacttactaccgttacggaccgaagggaccaacgtacgtaggacgtattaaaaccgg

SEQ ID NO: 171912 - DNA, 604 bp, Homo sapiens
  misc_feature: GYAE6OF02H87J8.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctccaaagctcctcatcaaagtatgccttcccagtcccttctccgacggggttccccctcgtaggttcagtcggcagtggatcgtggggacacgtactttccaccctcacctatcaaatagcctaggaacgcttaggaagtatcgacttgtacctaaactttacttacctaggttacctaattccaaggtaacgttaacctaaccttttaccctaacgtaacgtgaacttcctaaccccgtttaccggaccgtaaacggggaccaaccggtaaccgtacgggtagtaacgtttaaaaccgg

SEQ ID NO: 171913 - DNA, 527 bp, Homo sapiens
  misc_feature: GYAE6OF02H478X.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggagtagcttacactggtaccagcagaagccaggtcagtctccaaagctcctcatcaagtatgcttcccagtccttctcgacggggtcccctcgaggttcagtggcagtggatcgtgggacacgatttccaccctcacccatccaatacgccctaggaacgctagaagatgctgactaactttattactgtcatcagtagtacttactttacctcaatgactctaccttcggaccaaggacacgactaggaataacttaaacgacgtgtgctacgccacacttctgttacc

SEQ ID NO: 171914 - DNA, 496 bp, Homo sapiens
  misc_feature: GYAE6OF02GMRUN.27.78.H01.1.454.CMB.1.raw
  modified_base (195)..(195): a, c, t, g, unknown or other
  misc_feature (195)..(195): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggagtagcttacactggtaccagcagaagccaggtcagtctccaaagctcctcatcaagtatgcttcccagtccttctcaggggtcccctcgaggttcagtggcagtggatctgggacacatttcaccctcaccatcaatacgcctggaagctagaagatgctgactaacttattactgtcatcagagtactactttacctnaagtgatctacttcggacaaggcacgactggagtataacgactgtcgctgcacatctgtctc

SEQ ID NO: 171915 - DNA, 538 bp, Homo sapiens
  misc_feature: GYAE6OF02F3ZVZ.27.78.H01.1.454.CMB.1.raw
  modified_base (146)..(146): a, c, t, g, unknown or other
  misc_feature (146)..(146): n is a, c, g, or t
  modified_base (441)..(441): a, c, t, g, unknown or other
  misc_feature (441)..(441): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtgatctgggacacatttcaccctcaccatcaactacgcctggaagcgtagaaagatgcctgacctaaacttattactgtctatccagagttacctactttaccnctaagtgactctaccgttcgaccgtaaggacaccgactggaacgtaattaaacggaacttggtcggtactcgactaccctagttcctcgttcttacg

SEQ ID NO: 171916 - DNA, 551 bp, Homo sapiens
  misc_feature: GYAE6OF02FWHE7.27.78.H01.1.454.CMB.1.raw
  modified_base (327)..(327): a, c, t, g, unknown or other
  misc_feature (327)..(327): n is a, c, g, or t
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtntgcttcccagtccttctcacggggtcccctgacggttcagtggcagtggatcgngggacacgatttccaccctcacctatccaaatacgcccgtaggaacgctaggaagagtgctgactaacttattactgtactatcacgtagtaccttactttacctactaagtcaacttcctacccgttcgaccgaacgggccaaccggacgtaggactacgttaaaccgg

SEQ ID NO: 171917 - DNA, 598 bp, Homo sapiens
  misc_feature: GYAE6OF02GR4JC.27.78.H01.1.454.CMB.1.raw
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgccttcccagttcccttctcgacggggtcccctcggacggttcgagtggcaggtggatcgtgggacactatttccaccctcaccatcaatacgcctaggaacgtctaggaacgntcgctgactaacttacttacttgtactactacagtaagttaccttaaccgtttacctacgtaaacgttcgtaaccttcccgtaacccgtttaccggaacccgtaaacggggtacccgaacggtaccggtaagggtaaccgtaagttaaaaccggg

SEQ ID NO: 171918 - DNA, 507 bp, Homo sapiens
  misc_feature: GYAE6OF02G35WO.27.78.H01.1.454.CMB.1.raw
  modified_base (498)..(498): a, c, t, g, unknown or other
  misc_feature (498)..(498): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacattcaccctcaccatcaatagcctggaacgctagaagatgctgactaacttattactgtcatcagtagtactactttacctactaagtgatcaccttcggaccaagggacacgacgtggaacgaattaaacgactgtggctgcacntctgtcttc

SEQ ID NO: 171919 - DNA, 603 bp, Homo sapiens
  misc_feature: GYAE6OF02HJI3E.27.78.H01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtgtgagtagtttgggtttgggagtgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtccaccgagtcacctgccgggccagtcagancgttggaggtagcttacactggtaccagccagaagccaggtcacgtctccaaagctcctcatacaagtatcgcttcccacgtccttctcacgggtcccctcgacggttcagtcggcgagtcggactcgtgggactacgtactttccacccctactaccctataccgaatttacgcccgttagggaacgtctaaggaacgtacgtacggactagtacctaacttacttacttgtccattccagtacttaccttacttacctacagtcgtactaccgtaccgttacggaccgaacggacaccgtacgaggtacgaacttaaccggaacgtacggtacggactacgaccgtaccgactcgttacgtccttaccg

SEQ ID NO: 171920 - DNA, 555 bp, Homo sapiens
  misc_feature: GYAE6OF02I1FLV.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgccttcccagtccttctcacggggtcccctcgagttcagtgcagtggatcgtagggacactatttccaccctcaccatcaatagcccgtaggaacgctagaagatgctgactaactttattactgtcatcagagttacttactttacctcaagtcgtatcctaccgttaccggaccaagggaccacgacgtagggtaacgtaaacgttaaacgaacgttggtacggactcggaccaccgtacttcctacggttaccc

SEQ ID NO: 171921 - DNA, 547 bp, Homo sapiens
  misc_feature: GYAE6OF02H2H2O.27.78.H01.1.454.CMB.1.raw
  modified_base (198)..(198): a, c, t, g, unknown or other
  misc_feature (198)..(198): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtcctttctcctaggggtcccctcggacggttccagtcggcaggtggatcgtggggacacgatttcaccctcaccatcaatagcctaggaacgctagaagatgactgctaactttatactntcatcanagttactactttacctnaattgacttctaccttcggaccaagggacacgtactagggaacgtaagttaaaccgacttggtacggcttagacctaacccattccgttagttaccc

SEQ ID NO: 171922 - DNA, 676 bp, Homo sapiens
  misc_feature: GYAE6OF02GS70B.27.78.H01.1.454.CMB.1.raw
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggtagtgagcaaaactagacaagtacaaggacaggaagatgttgccatcacaactcattgggtttctgctgctctgggttccagcctccagggtgaattgtgctgactcagtctccagactttcagtctgtgactccaaaggagaaagtcaccatcacctgccgggccagtcagagcgttggtagtagctttacactggtaccagnaagaagccaggtacacgtctacccaaagctccctanatacaaagtatgcctttacccagttaccttctacacggggttcccctcggaggttcagtggcagtggatcgngggacactatttccacccctnaccatcaaatagccgtaggaagctagagaattgaccgtgaactaaaccgtttaattacgtagtactactaacgtagtacgtttaaccttaaccgttttaccctacgtaaaggttcgaacttacccgtacccgtttaccggaaacggtaaaacgggggtaacccaaccggggttaacctttacgggggaagttaaaacccttttaaaaacgggaacccggttacgttaaggggttacccttacggacccgtaaaccccttacgtaccgtttcggttacctttaaccc

SEQ ID NO: 171923 - DNA, 507 bp, Homo sapiens
  misc_feature: GYAE6OF02GZZ0C.27.78.H01.1.454.CMB.1.raw
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtgatcgtgggacacatttcaccctcaccatcaatagcctaggaagctagaagatgctgacaacttattactgtcatcagacttactactttaccncaagtgatcaccttcggaccaaggacacgactggaagtaattaaacgactagtgctgcacctatctgtc

SEQ ID NO: 171924 - DNA, 531 bp, Homo sapiens
  misc_feature: GYAE6OF02H9YPA.27.78.H01.1.454.CMB.1.raw
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcgttggtagtagcttacactggtaccagcagaagccaggtcagtctccaaagctcctacatcaagtatgcttcccagtccttctcacgggtcccctcgaggttcaggtgcagtgatcgtggacacgatttccacctcacatcaatagcctaggaanctagaagatgctgactaacttattaacctgtacatacaagtagtaaccttactttaccctanaagtgaattcaccttcggaccaaagggacacgacgtggaagtaacttaaacgaacgtgtacggctgaccacctatctgtcttac

SEQ ID NO: 171925 - DNA, 587 bp, Homo sapiens
  misc_feature: GYAE6OF02G8O2S.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcgccgggcagtcagagcgttggtagtagcttacactggtaccagcagaagccaggtcacgtctaccaaagcctcctcatacaagtatcgcttcccacgttccttctcgacggggtccctcggtacggttcagtggcaggtggatcgtcgggacacgtactttccaccctcaacctatacctaaatacgaccctagggaaacgctagaaatgtgcctagactaacttattaactgtacatcgtaagacgttaaccttactttacctagttaagtacgtaaccttaccgtaccgttaccggaccgtaacgggacctacgaacggtcggaacgtagtaaaaccgg

SEQ ID NO: 171926 - DNA, 524 bp, Homo sapiens
  misc_feature: GYAE6OF02HCC8L.27.78.H01.1.454.CMB.1.raw
  modified_base (318)..(318): a, c, t, g, unknown or other
  misc_feature (318)..(318): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctccncatcaagtatgcttccagtccctctcacgggtcccctcgacggttcagtggcagtggatcgtgggacacatttcaccctcaccatcaaatagcctggaacgctgaagatgcctagccaaacttattactgtcatcagtatactactttacgtacaagtntatcaaccttcggacctaacgggccacgacgtgagtaattaaaccgg

SEQ ID NO: 171927 - DNA, 511 bp, Homo sapiens
  misc_feature: GYAE6OF02GL35Z.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatagcctggaanctagaagatgctgacaacttattactgtacatcagtacgtacttactttaccataagtgatccaccttcggaccaagggacacgactggagtaattaaacgactgtggctgcaccatctgtcttac

SEQ ID NO: 171928 - DNA, 544 bp, Homo sapiens
  misc_feature: GYAE6OF02FSH0J.27.78.H01.1.454.CMB.1.raw
  modified_base (417)..(417): a, c, t, g, unknown or other
  misc_feature (417)..(417): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatctgggacacatttcaccctcaccatcaatagcctggaacnctgaagatgctgcaactttattactgtcatcagtacgtacttacctttacctacaagttgacttcctaaccgtttccggacccgtaacgggaccaaccggtacgtacggtaacgtacttaaaaccgg

SEQ ID NO: 171929 - DNA, 580 bp, Homo sapiens
  misc_feature: GYAE6OF02GGXIU.27.78.H01.1.454.CMB.1.raw
  modified_base (418)..(418): a, c, t, g, unknown or other
  misc_feature (418)..(418): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagccttacactggtaccagcagaagccaggtcagtctaccaaagcctcctcatcaagtatgcttcccagtccttctcgacgggtcccctgaggttcagtggctagtggatcgtgggacactatttccaccctcaccatcaatgacctaggaagctagaagatgctgacctaactttntaacttgtcactacgtaagtacgttaaccttaccgtttaacctacgtaaagttcgtacttacctaccgttaccggacccgtaagggacctacgtaacgtaggaacgtaactttaaaccgggacttaggtcggcttcggacctaacctagttccgtagttacc

SEQ ID NO: 171930 - DNA, 526 bp, Homo sapiens
  misc_feature: GYAE6OF02GZDR2.27.78.H01.1.454.CMB.1.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcagtggcagtggatcgtgggacacgatttccaccctcaccatcaatacgcctggaacgctagaagatgctgctaacttattactgtcatcagtatacttactttacnctaagtnacttcaccttcggaccaaggacacgngtaggagtaacgtaacgacgtggtacgctacgcctacctatcgttcgtcttacc

SEQ ID NO: 171931 - DNA, 523 bp, Homo sapiens
  misc_feature: GYAE6OF02IM30Z.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgctcccagtcctctcagggtccctgagttcagtgcagtgatctgggacacatttcaccctcaccatcaatacgcctggaagctagaagatgctgacaacttattactgtacattcagtacgttacttactttacctacaagttgaactcctaccttcggacctaacgggaccaccgacgtaggagtataaaccgg

SEQ ID NO: 171932 - DNA, 519 bp, Homo sapiens
  misc_feature: GYAE6OF02HGX81.27.78.H01.1.454.CMB.1.raw
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgagttcagtggcagtggatctgggacacatttcaccctcaccatcaatagcctggaanctagaagatgctgctaacttattactgtcatcagtagtacttactttacctactaagtgactcaccttcggaccaagggaccacggactaggacgtaacttaaacgaactggtggctacgcacctatctgtcttaccg

SEQ ID NO: 171933 - DNA, 542 bp, Homo sapiens
  misc_feature: GYAE6OF02H3IO0.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaccatcacctgccggcagtcagagcgttggtagtagcttacactggtaccagcagaagccaggtcagtctccaaagctcctcatcaagtatgcttcccagttcccttctcgaggggtcccctcgaggttcagtggcagtggatcgtgggacacgtatttccaccctcaacctatacaatacgccctaggaacgctagaagatgctgactaaactttattacctgtccaatccaagtacgtactactttacctactagtgactcaaccttcggccgaaggacaccgtactaggagtaattaaacgg

SEQ ID NO: 171934 - DNA, 550 bp, Homo sapiens
  misc_feature: GYAE6OF02ISQM6.27.78.H01.1.454.CMB.1.raw
  modified_base (330)..(330): a, c, t, g, unknown or other
  misc_feature (330)..(330): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcngtggcagtggatctgggacacgatttcaccctcaccatcaatacgcctggaacgctgaagatgctgacaacttacttactgtacatacagtagtactactttacctntaagtntactcaccgtttcggaccgtaagggacctaacggaccgtaggaacgtaacttaaaccggaacgtcggtaggtaccttggaccacccgtatccttaggtcctttaccg

SEQ ID NO: 171935 - DNA, 520 bp, Homo sapiens
  misc_feature: GYAE6OF02GGD7Y.27.78.H01.1.454.CMB.1.raw
  modified_base (470)..(470): a, c, t, g, unknown or other
  misc_feature (470)..(470): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatcgtgggacacatttccaccctcaccatccaaatagcctggaacgctagaacgatgctgctaacttattactgtcatcagtatactacttaccntaagtgatccaccttcggaccaagggaccacggactggacgtataaaccg

SEQ ID NO: 171936 - DNA, 512 bp, Homo sapiens
  misc_feature: GYAE6OF02GVJZC.27.78.H01.1.454.CMB.1.raw
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtccttctcaggggtcccctgagttcagtgcagtggatctgggacacatttcaccctcaccatcaatagcctggaacgctagaagatgctgacaacttatactgtcatcagagtactactttaccncaagtnatcaccttccggacaagggtacacgacgtacggagtataaaccg

SEQ ID NO: 171937 - DNA, 567 bp, Homo sapiens
  misc_feature: GYAE6OF02G0R0K.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgacggttcagtggcagtggatcgtgggacacatttcacctcaccatcaactagcctaggaagctagaagatgctgactaacttattactgtacatacagtacgtacttactttacctactaagtcgtacttcgacccgtttacggaccgaacgggaccacgtaacgtagggaaacgtaacgtttaaaccggaacttcggtagggtcctaggaccctaacccgtacttccgtagttaccg

SEQ ID NO: 171938 - DNA, 498 bp, Homo sapiens
  misc_feature: GYAE6OF02G4YYF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctagaagatgctgactaacttattactgtcatcagatactactttacctcaagtgatctaccttcggaccaagggacacgactggagattaacgactgtgctgcacatctgtcttc

SEQ ID NO: 171939 - DNA, 512 bp, Homo sapiens
  misc_feature: GYAE6OF02ICLJF.27.78.H01.1.454.CMB.1.raw
  modified_base (507)..(507): a, c, t, g, unknown or other
  misc_feature (507)..(507): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacactattcaccctcaccatcaatacgcctaggaagctagaagatgctgacaacttattactgtcatcagtatactacttacctcaatgatcacctttcggccaagggacacgtacgtaggagaacttaaacgacgtgtagctgactaccatctcgtnttacc

SEQ ID NO: 171940 - DNA, 739 bp, Homo sapiens
  misc_feature: GYAE6OF02G233B.27.78.H01.1.454.CMB.1.raw
  modified_base (236)..(236): a, c, t, g, unknown or other
  misc_feature (236)..(236): n is a, c, g, or t
tcagagcgtcgtctcacgaccggtgctcgatttagtgtgagtagtttgggtttggggagtctttaaaagaggttctttctctgggatgtggcatgagcaaaaactagacaaagtcaaggcagggaagatgttgccatcacaactcattgggtttctgctgctctgggttccagcctccaggggtgaaattggtgctgactcagtctccagactttcagtctgtgactccaaagganaaagtcaccatcacctgccggcagtcagagcgttggtagtagcttacactggtaccacgcgagaagccaggtcagtcgtccaaagtcctcctcatcaagtatcgcttccccagtcccttactccgacggggttccccctacggacggtttcaggtcggacctaggtcggactccgtaggggtacctaaccgtactttaccaccccttacgaaccctataccaaacgttacggcccgttacgggaaacgtaccgttaacggaaacggtacgttacggacccgttaggtacccttaaaccgttttacgtttaaccgttacgggttaccctaacgttaccgaaggttaaaccggttaacctttaaccctttttacccgtaccgttaaacggtttcggttaacgttacccgttaacccggtttacccgggtaaccccggtaaacgggggtaacccgtaaccggtaaccggtttacggggtaaccgtaaccggttttaaaaacccggg

SEQ ID NO: 171941 - DNA, 555 bp, Homo sapiens
  misc_feature: GYAE6OF02IGPA8.27.78.H01.1.454.CMB.1.raw
  modified_base (437)..(437): a, c, t, g, unknown or other
  misc_feature (437)..(437): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagttcccttctccacggggttcccctggtacggttcagtggcaggtggatcgtgggacactatttccaccctcaccatcaatacgcctaggaagctagaagntgctgactaacttattactgtactatcagtagttaccttacttttacctactaagtgtaactcctaacccgttcggaccaacgggacctaacggtacgtagggaacgtattaaaccgg

SEQ ID NO: 171942 - DNA, 560 bp, Homo sapiens
  misc_feature: GYAE6OF02GAM4G.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgctcccagtccttctcagggtcccctcgaggttcagtggcagtggatcgtgggacacgactttcaccctcaccatacaactagcctaggaagctagaagatgctgactaacttattactgtcatcagacgtacttactttacctactaagtagtactaccaccttaccggaccgaaagggaccaacggacgtgggaacgtaagttaaaaccggaacgttacgtacggtctacgtaccaaccgtactcttacggttcctttaaccg

SEQ ID NO: 171943 - DNA, 526 bp, Homo sapiens
  misc_feature: GYAE6OF02GBV4E.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagaggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtcccttctcacgggtcccctcgaggttcagtggcagtggatctgggacacatttccaccctcacctatcaatacgccttggaagctagaacgatgctagacctaacttattactgtcatcagagtactactttacctctaagtgatcctacccttcggaccaagggaccaccgacgtacggagtaaacgg

SEQ ID NO: 171944 - DNA, 552 bp, Homo sapiens
  misc_feature: GYAE6OF02H9MBY.27.78.H01.1.454.CMB.1.raw
  modified_base (488)..(488): a, c, t, g, unknown or other
  misc_feature (488)..(488): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagcgttggtagtagcttacactggtaccagcagaagccaggtcagtctccaaagctcctcatcaagtatgtcttcccagtcccttctcgcggggtcccctcgaggttcaggtgcaggtggatcgtgggacactactttccaccctcacctatcaatacgccgtaggaacgctaggaagatgctgctaacttattactgtcatcagtaacgttacttactttacctanaagttgaacttcgtaccgttccggaaccgtaacgggacaccgacgtaggtacgaattaaaccgg

SEQ ID NO: 171945 - DNA, 530 bp, Homo sapiens
  misc_feature: GYAE6OF02JE9YR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaacgctagaagatgctgacaacttattactgtcatcagtacgtactactttacctactaagtgtactcgtaccttccggaccaaagggaccacggactaggacgtaacttaaacgtactagtcggctacgccacctatcttagtcttac

SEQ ID NO: 171946 - DNA, 558 bp, Homo sapiens
  misc_feature: GYAE6OF02JCUOB.27.78.H01.1.454.CMB.1.raw
  modified_base (195)..(195): a, c, t, g, unknown or other
  misc_feature (195)..(195): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcagggtcccctgagttcagtgcagtgatcgtggacncatttcaccctnaccatcaatagcctgaanctagaagatgctgacaacttattactgtcatcagtacgtactacctttactcctaagttcgaactccaacccgtttcggaccctaaacgggacaaccggtacgtaggaacgtaacgtttaaaaccgaacgttaggtacgggtacctacggtccaacccgtattccgtacggttccttaccg

SEQ ID NO: 171947 - DNA, 546 bp, Homo sapiens
  misc_feature: GYAE6OF02IU0QJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttcaccctcaccatcaatacgcctaggaagctagaagatgctgactaacttattactgtacatcagattacctactttacctacaagtgatccacctttcggacccaaagggccaacgacgtagggaacgtaacgttaaaaccgacgtacggtacggtacttcggacctaccattcgttacgtcctttaccg

SEQ ID NO: 171948 - DNA, 569 bp, Homo sapiens
  misc_feature: GYAE6OF02GVP5T.27.78.H01.1.454.CMB.1.raw
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggatgagcaaaattgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagcagaagccaggtcagtctccaaagctcctcatcaagtatgcttcccagtccttctcaggggtcccctgaggttcagtggcagtggatcgtgggacacgatttcaccctcaccatcaatacgcctaggaanctagaagtatgctgactaacttattacttgtacatacagtacgttaaccttactttaaccctactaacgtcgaattccacccgtttccgggaccaaacggggaccaccgtaccgtgggaacgtaacttaaaacgacgttaggtacggtacctaggtaccaccgtatccgttgtcctttaccg

SEQ ID NO: 171949 - DNA, 582 bp, Homo sapiens
  misc_feature: GYAE6OF02IP4ES.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttccagtccttctcacggggtcccctgaggttcagtggcagtggatcgtgggacactatttcacccctcaccctaataccaaattacggacccttagggaaagtccttaggaaacgtattaggccttaggacctaaacctttatttaactgtactatccgaagtaacgttacttaacttttaccctgaaagttgacttcaacccttcggaccgaacgggtacacgacgtaggaacgtaattaaaccggaacgttgtaggcttgcctaacctgttcctgttacc

SEQ ID NO: 171950 - DNA, 510 bp, Homo sapiens
  misc_feature: GYAE6OF02GIZBS.27.78.H01.1.454.CMB.1.raw
  modified_base (439)..(439): a, c, t, g, unknown or other
  misc_feature (439)..(439): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacgatttcaccctcacccatccaatagcctaggaagctgaagatgctgcaattattactgttcatcagtagtactactttacctnaagtgatcaccttcggaccaagggacacgactaggacattaaacgacttgtgctgaccacacttctgtacc

SEQ ID NO: 171951 - DNA, 583 bp, Homo sapiens
  misc_feature: GYAE6OF02GPADY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaccatcacctgccgggccagtcagagcgttggtatagcttacactggtaccagcagaagccaggtcagtctaccaaagctcctcatcaagtatcgcttcccagtccttctcgacgggtcccctcgaggttcagtggcagtggatcgtgggacacgtatttacaccctcaaccattacaactacgcctaggaacgcgtagaagatcgctcgactaactttattactgtacctatcgaagtacgttaacttactttaccactaagtcgaacttcctaaccgtttaccggaccgaagggaccaccgtacgtaggtaaggtaactttaaaccggacgtaggtacggtcgttacgacctaacccagttccgttacgttaccttaccg

SEQ ID NO: 171952 - DNA, 501 bp, Homo sapiens
  misc_feature: GYAE6OF02FFSOE.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgcccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatacgcctggaagctgaagatgctgaccaacttattactgtcatccagtagtactactttaccacaagtgatccacttcgacaaggacacgactggagtaataacgactgtgctgcaccatctgtctac

SEQ ID NO: 171953 - DNA, 519 bp, Homo sapiens
  misc_feature: GYAE6OF02IMAV6.27.78.H01.1.454.CMB.1.raw
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcggtaggttcagtggcagtggatcgtgggacacactttccaccctcaccataccaatacgcctaggaagtctagaagatgctgactaacttattactgtcatcagtacgtacttactttacctanaagtnactctaccttcggacaaagggcacgactaggagtaataaacgatgtagctgcaccatctgtactc

SEQ ID NO: 171954 - DNA, 569 bp, Homo sapiens
  misc_feature: GYAE6OF02FKRW2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcgacgggtcccctcgaggttcagtggcagtggatcgtgggacactatttcaccctcaccatcaatacgcctggaagctagaagatgctagacctaacttacttactgtcatcgaagtacgttaaccttaacctttacctactaagtacgtaacttccgtaacccttcggaccgaagggaccaacgtacgtaggaagtaacgttaaaccgaaacgtggttacggcgtacgacctaaccgtacgttacctgttacttaccg

SEQ ID NO: 171955 - DNA, 603 bp, Homo sapiens
  misc_feature: GYAE6OF02GAFO8.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatacaagtatcgccttcccagttccttctcgacggggtcccctggacggttcagtggcagtggatcgtgggacacgtactttccgacccctcacctataccaaacgtacgccctaggaacgtcgtagaagtatacgccttacgtacctaactttacttacctagtactattacaacggtaacgttaacttacccttttacctacgtaagttcgtaactccgtaacccgtttccggacctaacgggtaccaaccggtacgtacgggtaacgtaacgttaaaccgg

SEQ ID NO: 171956 - DNA, 510 bp, Homo sapiens
  misc_feature: GYAE6OF02G9R9B.27.78.H01.1.454.CMB.1.raw
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctccaggggtcccctcgaggttcagtggcagtggatctgggacacatttccaccctcaccatcaatagcctggaanctgaagatgctagcaacttattactgtcatcagagtactactttacctcaagtnattcaccttcggaccaagggaccacgactaggataacttaaacgactgtggctcggcaccatcgtagtc

SEQ ID NO: 171957 - DNA, 580 bp, Homo sapiens
  misc_feature: GYAE6OF02I4GCF.27.78.H01.1.454.CMB.1.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (523)..(523): a, c, t, g, unknown or other
  misc_feature (523)..(523): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaattgtgctgactcagtctccagactttcagtctgtgactccaaaggngaaaagtcaccatcacctgccgggccagtcagagcgttggtagtagcttacactggtaccagcaagaanccaggtcagtactccgaaagctcctcatcaagtatcgccttcccagttcccttcgtcgtacggggtcccctggaggtttcagtcggcagtggatcgtgggactactatttccaccctnaccntacaaatcgcctaggaanctaggaaanactcgattcgaactaaacgttacttacttgtaccaagttccaagtacgtaacctttactttaacctgaagttgaacttcctaacccgttcggaccaaagggccaccgngtagaacggtaaattaaaccgatacgggtgactgaccacctaagtccttgaccctta

SEQ ID NO: 171958 - DNA, 658 bp, Homo sapiens
  misc_feature: GYAE6OF02IMRT3.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaaggagaaacgtccccatcacctcgccgggccgagtcacgagtcggttggtagtagcttacactcggtaccagcagaagccaggtcacgtactaccaaacgtctcctacatacaagtatcgtccttcccacgtccttctcgacgggtcccctcgaggttcgagtcggcgaggtcggatcgtggacactacttccaccctacaccactacaagtacgcgtaggaactcgtaagaagtactgcttagactaaactttaactttactacgttacaattcgaaagtacgttaacctttaacctttaaccgttacgaaaggttcgtaaccttacccgtacccggtttaccgggaacccgtaaacgggtaaccgtaacggtaccgttagggtaaacgtaaacgtttaaaccgtaacgttgggtaccggtacgttagaccgaaccttagttccttcgttccctacttaccg

SEQ ID NO: 171959 - DNA, 578 bp, Homo sapiens
  misc_feature: GYAE6OF02HZADI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagttccttctcgtacggggtcccctgacggttcagtcggcagtggatcgtgggacactacgtttccaccccgttcaccctactcaaatacgacccgtaggaagcgtagaaagtatgctagacctaactttacttaactgtacatcagtagtacttaactttacctactaagtcgaactcctaccgttcggaccgaaacgggaccacggacgtaggaacgtaacttaaaccggacgtaggtcggacgtcgaccaacctacgttctcgttaccttacc

SEQ ID NO: 171960 - DNA, 518 bp, Homo sapiens
  misc_feature: GYAE6OF02GM91R.27.78.H01.1.454.CMB.1.raw
  modified_base (452)..(452): a, c, t, g, unknown or other
  misc_feature (452)..(452): n is a, c, g, or t
  modified_base (484)..(484): a, c, t, g, unknown or other
  misc_feature (484)..(484): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgccttcccagtcccttctccacggggtcccctcggaggttcagtggcagtggatctgggacacatttccaccctcacccatccaatacgcctaggaagctagaagatgactgactaacttattactgtcatcatagtactacttacctacaagtnactctacttcggaccaaggacacgactggaanaattaaacgattgaggctgaccacagtctgttcc

SEQ ID NO: 171961 - DNA, 516 bp, Homo sapiens
  misc_feature: GYAE6OF02GET79.27.78.H01.1.454.CMB.1.raw
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagttccttctcgacggggtcccctcggaggttcaggtggcagtggatcgtgggacactatttccaccctcaccatcaatacgcctaggaagctagaagtatgctgactaactttattactgtcatcagtagttactacttactcaagtgatcaccttcggaccaaggcacgactggaataattaaacgactgtggctgaccacntctntcc

SEQ ID NO: 171962 - DNA, 693 bp, Homo sapiens
  misc_feature: GYAE6OF02HGHQC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatcgcttcccagtccttctcgacgggtcccctcgtacggttcaggtggtcagtggactcgtgggaacctacgtacgtttccacccttaccaaccgtatacctaagtacgtaccgtaggaaacgtctaggaaacgtactacggtctacggtaacctaaaccgttttaattaccgttacgttactaacttaccgtaaggttaaccgttaacctttaacccttttaacccggttaactaaacggtttacgtaaccttacccgttaccgttacccggggaaactaaaccggggacctaaccggttacggtaacgggtaacgtaaacgttaaaacccgggtacgttagggttacgacccggttacgaccctaacccgtaagtttccgtcgtttaccctttaacccg

SEQ ID NO: 171963 - DNA, 511 bp, Homo sapiens
  misc_feature: GYAE6OF02IWXWJ.27.78.H01.1.454.CMB.1.raw
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgagttcagtggcagtggatctgggacacatttcaccctcaccatcaatagcctggaanctgaagntgctgcaacttnttaactgtcatcanagttactactttacctctaagtnatcctaccgttcggaccaagggacacgactggaanaacttaaacgactgnggctgacaccatcctgtcc

SEQ ID NO: 171964 - DNA, 493 bp, Homo sapiens
  misc_feature: GYAE6OF02GGZOO.27.78.H01.1.454.CMB.1.raw
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgccaacttatactgtcatcagatactactttaccncagtnatcaccttcggaccaaggcacgactggagattaaacgacgtgtgctgcaccatctgtctc

SEQ ID NO: 171965 - DNA, 614 bp, Homo sapiens
  misc_feature: GYAE6OF02ISJ5C.27.78.H01.1.454.CMB.1.raw
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcnccaaagctcctcatcaagtntgccttcccatccttctcgacgggtccctcgaggttcagtggcagtgatcgtggacacatttccaccctcaccatacaagtacgccgtaggaacgcgtagaaaggctcgcttagacctaaactttacgttaacttgtacaacttcgaagtaacggtttaaccttaacgtttaacccttaacgtaacgttacgtacgttaccctaacccggtttaccggacccgaaaacgggtaccaacggtacgtagggtaacgtaacgtttaaaaccggaacgttaggcggtaccttagacctaccgtacttccttaggtccttaaccg

SEQ ID NO: 171966 - DNA, 655 bp, Homo sapiens
  misc_feature: GYAE6OF02INX35.27.78.H01.1.454.CMB.1.raw
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (393)..(393): a, c, t, g, unknown or other
  misc_feature (393)..(393): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcacatcacctgccgggcagtcagagcgttnatagtagcttacactggtaccagacagaacgccgaggtcagtctaccaaagtctcctacatactaagtatcgtccttcccacgtcctttctacgacggggtcccctcgaggttcaggtggcgagtcggacttcgtcgggacactactttaccaccctcaacncgtacaagtacgaccgtaggaacgcgtagaagtagtacgctagactaaactttattacttcgtactacttacgaacgtaacgttaaccgttaaccttttaaccctacgtaaacgttacgtaacttccgtaaacccgtttcggaacccgtaaacgggtaccgtaccggtaacgttaacgggtaaagtaaaccgtttaaaacggtaaccgttacgggtacgtaccgttacggaacctaaccgtacgttaccgttcgtttaaccc

SEQ ID NO: 171967 - DNA, 501 bp, Homo sapiens
  misc_feature: GYAE6OF02GGDOG.27.78.H01.1.454.CMB.1.raw
  modified_base (496)..(496): a, c, t, g, unknown or other
  misc_feature (496)..(496): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgctaacttattactgtcatcagatactactttactacaagtgatcaccttcggaccaagggacacgactaggagattaaacgatgtgctgcacctatcgtntcttc

SEQ ID NO: 171968 - DNA, 522 bp, Homo sapiens
  misc_feature: GYAE6OF02I4LSC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccagtcagtctccaaagctcctcatcaagtatgccttcccagtccttctcacgggtccctgaggttcagtgcagtgatcgtggacacatttcaccctcaccatacaatagcctggaagctagaagatcgctgactaaccgttatttactgtcattcagtatactactttacctcatgatcacctttcggaccaagggaccacgataggaacgtaattaaaaccgaacgtgtacggctacgcacctatcgttgtccttaccg

SEQ ID NO: 171969 - DNA, 550 bp, Homo sapiens
  misc_feature: GYAE6OF02GNG3D.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgtaggttcagtggcagtggatcgtgggacactatttccaccctcaccatcaactagccgtggaagctaggaagtatgctgacctaattattactgtcatcagtagttacttactttacctagaagtgacttacgaccttcggaccgaagggaccacgacgtagggaagtaacgttaaacgacgttaggtacgacgtcgacctaccgtacttcctgttacccg

SEQ ID NO: 171970 - DNA, 558 bp, Homo sapiens
  misc_feature: GYAE6OF02GEOPA.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctcaaagctcctcatcaagtatgccttcccagtccttctcacggggttcccctggtacggtttcaggtggctaggtggactcgtggggacactatttccaccctcaccatcaaatacgcctggaacgctagaagatgctagctaacttattactgtcatcaagtagtacctactttacctctaacgtgaacttccgaaccgtttccggaccgaacgggacctaaccggacgtacggaacgtaagttaaaaccgg

SEQ ID NO: 171971 - DNA, 615 bp, Homo sapiens
  misc_feature: GYAE6OF02IFJFA.27.78.H01.1.454.CMB.1.raw
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatcacctgccgggcagtcagagcgttggtagtagcttacnctggtaccagcagaagccaggtcagtctaccaaagctcctcatcaaagtatcgtcttcccagtccttcgtcgtacggggtccccctcggtaggtttccaggttcggcaggtggatcgtagggaccactactttccaccctcaaccactacaactacgcctaggacgactagaaacgatgactgacctaacttactttactagtcatccaagtacgttaaccttactttaacctagtaagtactacttaccgtaaccgtttccgggaaccaagggaaccgtaccggacgtaacgggaacgtaaacgttaaaacgaaccgttgtaacgggtccgtaagcctaacccgtacgttaccttcgttaccttaccg

SEQ ID NO: 171972 - DNA, 498 bp, Homo sapiens
  misc_feature: GYAE6OF02F8AFJ.27.78.H01.1.454.CMB.1.raw
  modified_base (382)..(382): a, c, t, g, unknown or other
  misc_feature (382)..(382): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaanctgaagatgctgcaacttattactgtcatcagacgtactactttacctcaagtgatcaccttcggaccaagggacacgactaggagattaaacgactgtgctgcaccatctgtctc

SEQ ID NO: 171973 - DNA, 534 bp, Homo sapiens
  misc_feature: GYAE6OF02GSHGG.27.78.H01.1.454.CMB.1.raw
tcagagcgtcgtctcacgaccggtgctcgatttagtgtgagtagtttgggtttggggatacttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtccctcgaggttcagtggcagtggatcgtgggacacatttcaccctcaccatcaatacgcctggaacgctagaagatgctgctaacttattactgtacattcagtacgtacttaactttacctacaagttcaatcctaaccgttcggaccgaacgggacaacggaatagggataattaaaccgg

SEQ ID NO: 171974 - DNA, 696 bp, Homo sapiens
  misc_feature: GYAE6OF02F9K4Q.27.78.H01.1.454.CMB.1.raw
tcagagcgtcgtctcacgaccggtgctcgatttagtgtgagtagtttgggtttgggggtagtgagcaaaactgacaagtccaaggcaggaagatgttcgccatcacaactcattgggtttctgctgctctgggttccagcctccaggggtgaaattgttgctgactctagtctccagactttcagttctcgtgactccgaaaggagaaagtcaccatcgacctgccgggaccagtcagagcgttggtagtagcttacactggtaccagcagagccaggtcagtctccaaagtctcctcatcaagtatcgaccttcccgaggtcccttcgtcgtacggggtcccctcggaggttccaggttcggcgaggtggagttccgtgggactacgtactttaccacccgttacaccctactacctaaacgtacgacccgttaggaaacggtcctagggaaacgtacgtacggtcctttaggacccttaaacttttactttaacgttagtaccttaactaccgtaaagtaccgtttaacctttacccgttttaacccgtacgttaaggttaccgtacgtaacccgttaccgttaccggtaacccggaaagggtaacccaacggtacgtagggtaacgtaaacgttaaaccggacttagggtacggtacgttcgtacctaccgtactccgtttcgtccttaaccg

SEQ ID NO: 171975 - DNA, 666 bp, Homo sapiens
  misc_feature: GYAE6OF02G76YI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgacggggtcccctcggacggttcagtggcagtggatcgtgggacacgtactttccgaccctcacccatacaatacgcccttagggaaacgtccgtaggaaagtactacggccgtagtaccttaaacgtttaactttaacgttcggttacctaacttacgaacgtacgttaaccctttaaccttttaaccctacgtaaacggttcgtaacttaccgtacccgtttaccgggaccgaaacggggtaccaccggtaccgtaggggtaacgtaaacgtttaaaccggaaacgttcggtaccgggtaccgttacggacccgtaaccgttaacgttccgtttacgttccttttaacccg

SEQ ID NO: 171976 - DNA, 503 bp, Homo sapiens
  misc_feature: GYAE6OF02HRHNB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttccaccctcaccatcaatacgcctaggaacgctagaagatgctgctaacttattactgtcatcagtagtacttacttacctacaagtgatcacttcggacaaggacacgactggagattaacgatgtagctgcaccatctgtcttacg

SEQ ID NO: 171977 - DNA, 496 bp, Homo sapiens
  misc_feature: GYAE6OF02GMSR9.27.78.H01.1.454.CMB.1.raw
  modified_base (431)..(431): a, c, t, g, unknown or other
  misc_feature (431)..(431): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctagaagatgctgcaacttattactgtcatcagagtactactttaccncaagtgatcaccttcggccaaggacacgactggagaataaacgactgtgctgcaccatctgtctc

SEQ ID NO: 171978 - DNA, 512 bp, Homo sapiens
  misc_feature: GYAE6OF02GYQUF.27.78.H01.1.454.CMB.1.raw
  modified_base (195)..(195): a, c, t, g, unknown or other
  misc_feature (195)..(195): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctnaccatcaaatgcctggaanctgaagatgctgacaacttattactgtcatcagagtacctactttaccncaagtgtatccaccttcggacccaaagggaccacggactggaacgtaacttaaacgactgtcggctgcaccatctgtctc

SEQ ID NO: 171979 - DNA, 511 bp, Homo sapiens
  misc_feature: GYAE6OF02IZDAP.27.78.H01.1.454.CMB.1.raw
  modified_base (195)..(195): a, c, t, g, unknown or other
  misc_feature (195)..(195): n is a, c, g, or t
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaagganaaagtcaccatcacctgccgggccagtcagagcgttggtatagcttacactggtaccagcagaagccaggtcagtctccaaagctcctcatcaagtatgccttcccagtccttctcagggtcccctcgngttcagtggcagtggatctgggacacatttcaccctcaccatacaatacgcctaggaagctagaantgctgactaacttattactgtcatcagtagtacttactttaccanaagtnatctaccttcgaccaaggacacgatcggaagaataaaccgatgtacgctagccacctanccttgtcttacg

SEQ ID NO: 171980 - DNA, 593 bp, Homo sapiens
  misc_feature: GYAE6OF02IVF8V.27.78.H01.1.454.CMB.1.raw
  modified_base (381)..(381): a, c, t, g, unknown or other
  misc_feature (381)..(381): n is a, c, g, or t
  modified_base (418)..(418): a, c, t, g, unknown or other
  misc_feature (418)..(418): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgagttcagtgcagtgatcgtggacacatttccaccctcaccatcaatacgctagganctagaagatgctgacctaacttattactgtcatcganagttacctactttacctataacgtgtaacttcctaccgtttaccgggacctaaaggggaccctaaacggtaccgttacgggaacggtaaacgttttaaaaacccggaacgttacgggtaccggtaccgttacggtaccctaacccgtagttaccctttacggtccctttaacccg

SEQ ID NO: 171981 - DNA, 549 bp, Homo sapiens
  misc_feature: GYAE6OF02F6XE6.27.78.H01.1.454.CMB.1.raw
  modified_base (319)..(319): a, c, t, g, unknown or other
  misc_feature (319)..(319): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccctccaggggtgaaattgtgctgactcagtctccagactttcagtctgtgactccaaaggagaaagtcacatcacctgccggccagtcagagcgttggtagtagcttacacgtggtaccagcagaagccaggtcagtctccaaagctcctnatcaagtatgcttcccagtccttctcgacgggtcccctagaggttcagtggcagtggatcgtgggacactatttccaccctcaccatacaatacgctaggaacgtctagaagactgctgactaacttacttacgtgtacatcagtactaacttacttacctacgaagtgacttcctacccgttacggacccgtaacgggaccacggaccgtagggaactaagttaaaccg

SEQ ID NO: 171982 - DNA, 534 bp, Homo sapiens
  misc_feature: GYAE6OF02GMNNB.27.78.H01.1.454.CMB.1.raw
  modified_base (487)..(487): a, c, t, g, unknown or other
  misc_feature (487)..(487): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcgacgggtcccctcgaggttcagtcggcagtggatcgtagggacactatttccaccctcaccctatacaatacgcctagggaacgctagaagatcgactcgactaacttattactgtcatcagtagtactactttacacaagtnactctaccgttacggaccgaaggacacgtacgtggacgtataaaccg

SEQ ID NO: 171983 - DNA, 563 bp, Homo sapiens
  misc_feature: GYAE6OF02FR1PS.27.78.H01.1.454.CMB.1.raw
  modified_base (398)..(398): a, c, t, g, unknown or other
  misc_feature (398)..(398): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactgggtaccagcagaagccaggtcagtctccaaagctcctcatcaagtatgccttcccagtccttctcgacggggtcccctcgacggttcaggtggcagtggatcgtggacacatttccaccctcaccatcaatacgcctggaagctgaagntgctgactaacttattactgtcatcagtactacttactttacctacgaagtgactcctaccgttcggacccgaaagggaccaaccgtacgtagggaacgtaacgttaaaccgtaacgtaggttacggcgttacggacctaccgtacttcgttacgttccttaccg

SEQ ID NO: 171984 - DNA, 630 bp, Homo sapiens
  misc_feature: GYAE6OF02JLN4F.27.78.H01.1.454.CMB.1.raw
  modified_base (249)..(249): a, c, t, g, unknown or other
  misc_feature (249)..(249): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggtagtgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttaacnctggtaccagcagaagccaggtcagtctccaaagctcctcatcaagtatgcttcccagtccttcncgtacggggtcccctgtacggttcaggtgcagtggattcncgggactactatttccaccctacaccatacaatacgcccgttaggaaaccgtntacggaaagcttagcctagaccttaaactttattaccgtgttacataccgtagtaacgttacctttaactttaacccttacgaagttacgactttaccctaccgtttccggaacgaaacgggtaacaccgtacttaggggtaacgtaaaccgttaaaaggtacccttagggtcggtactaccggtaccaaaccccttaagttccgtttacgttccgtttaacc

SEQ ID NO: 171985 - DNA, 536 bp, Homo sapiens
  misc_feature: GYAE6OF02G3T0Q.27.78.H01.1.454.CMB.1.raw
  modified_base (410)..(410): a, c, t, g, unknown or other
  misc_feature (410)..(410): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcggaggttcagtggcaggtggatctgggacacatttccaccctcacctatcaatagcctaggaagctagaagatgctgactaacttnttactgtcatcagatactactttacctactaagtgactctaccgttcggaccaagggaccacggtacgtggaacgtaacttaaaccgaacgtggtacgacgtcgactacctatccttgtccttacc

SEQ ID NO: 171986 - DNA, 496 bp, Homo sapiens
  misc_feature: GYAE6OF02FI1LE.27.78.H01.1.454.CMB.1.raw
  modified_base (389)..(389): a, c, t, g, unknown or other
  misc_feature (389)..(389): n is a, c, g, or t
  modified_base (430)..(430): a, c, t, g, unknown or other
  misc_feature (430)..(430): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttctcacggggtccccctcgaggttcagtggcagtggatctgggacacatttcacctcaccatccaatgcctggagctgaagntgctgcaacttattactgtcattcagagtactactttaccnctagtgatctactcgccaagggacagactggagattaaacgactgtgctgcaccatcgtntcttcg

SEQ ID NO: 171987 - DNA, 548 bp, Homo sapiens
  misc_feature: GYAE6OF02HYR4H.27.78.H01.1.454.CMB.1.raw
  modified_base (440)..(440): a, c, t, g, unknown or other
  misc_feature (440)..(440): n is a, c, g, or t
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgacggttcgagtggcaggtggatcgtggggacactatttccacccctcacccatcaatacgacctaggaacgctagaagntgactgacctaattattactagtcatcagtaagtacttactttacctacaagtntactcaccgttccggaccaacgggacaccggacgtaggtacgtaattaaaccgg

SEQ ID NO: 171988 - DNA, 510 bp, Homo sapiens
  misc_feature: GYAE6OF02JEWWT.27.78.H01.1.454.CMB.1.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttctagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttcaccctcaccatcaatgcctggaanctgaagatgctgcaacttattacngtcatcagtagtacttacttacctcaagtgatccacgttcggaccaagggacacgtactggacgtaacttaaacgactggtggactgcaccgatcgtagtcttac

SEQ ID NO: 171989 - DNA, 502 bp, Homo sapiens
  misc_feature: GYAE6OF02JGSI6.27.78.H01.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtcctctcagggtcccctgaggttcagtggcagtggatctggacncatttcaccctcaccatcaatagcctggaagctagaagatgctgcaacttattactgtcatcagtagtactacttacctctaagtnatccaccttcggccaaggacacgactggacgattaaacgactggtgctgaccacatctcgtactttac

SEQ ID NO: 171990 - DNA, 635 bp, Homo sapiens
  misc_feature: GYAE6OF02G54RU.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtacgctacacgtcggtaccagcagaagccaggtcagtcaccaagcctcctcatacaaagtatcgtccttcccagttcccttcgtcgaccggggttcccctacggtacggtttctaggtcgggtaccgaaggttcggactcggtaggggaacctaaccgtactttacccaaccccgttacaacctaataccaaactacgacccgttagggaacgtccgtagaaacgtagtagacctagtacctaaactttatttaaccgtgtaccaattccaagtaacgtaccttaacgtttacctagtaacgtgtacttaccgtaccgttacggaccgtaacgggacctaccggactacggagtaacttaaacgg

SEQ ID NO: 171991 - DNA, 503 bp, Homo sapiens
  misc_feature: GYAE6OF02FRFHB.27.78.H01.1.454.CMB.1.raw
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatcgtgggacacatttcacccctcaccatcaatagcctggaagctagaagatgctgctaacttattactgtcatcagatactactttacctanaagtgatcaccttcggccaaggacacgactggagtaacttaaacgactgtcggctgcaccatctgtctc

SEQ ID NO: 171992 - DNA, 594 bp, Homo sapiens
  misc_feature: GYAE6OF02IGZ6T.27.78.H01.1.454.CMB.1.raw
  modified_base (229)..(229): a, c, t, g, unknown or other
  misc_feature (229)..(229): n is a, c, g, or t
  modified_base (346)..(346): a, c, t, g, unknown or other
  misc_feature (346)..(346): n is a, c, g, or t
  modified_base (440)..(440): a, c, t, g, unknown or other
  misc_feature (440)..(440): n is a, c, g, or t
tcagagcgtcgtctcacgaccggtgctcgatttagtgtgagtagtttgggtttgggcatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcactgccggccagtcagagcgttaggtagtagcttacactggtaccagcagaagccaggtcagtctaccaaagctcctcatacaagtatgccttccgattccttcncgtacggggtccccctaggtagttccaggtcggactaggtggatcgcggtacactagtttccaccctcacctatacgtaatacgcctaggaacnctagaaagtctcggactcgaaccttaacgttattaacgtcgttacaacttacaacggtacttaaccttacctttaacctacgaaagttacgactcccgtaacccgttcggtacccgaaacgggaccctacggtaacgtagggaattaaaaccgg

SEQ ID NO: 171993 - DNA, 597 bp, Homo sapiens
  misc_feature: GYAE6OF02IMSGA.27.78.H01.1.454.CMB.1.raw
  modified_base (196)..(196): a, c, t, g, unknown or other
  misc_feature (196)..(196): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatccactgccgggccagtcagagcgttggtagtagcttacactggtaccagcagaagccaggtcagtctccaaagctcctcatcaagtatgccttcccagtccttcgtccgtacgggtcccctcggtaggttcagtggcaggtggatcgtgggacactatttcaccctnacccatcaatanccgtaggaacgctagaagtntagcgtaggacctaaacttattacttgtacattcagtacgttaccttaacctttacctactaagtcgtaacttccgtacccgttacggacccgtaaacggggacctaaccggacgttacggaacgtaaacgtttaaaaccggaacttcggtacggtactcggacctacctacgtcttccggtacttaccc

SEQ ID NO: 171994 - DNA, 580 bp, Homo sapiens
  misc_feature: GYAE6OF02GFM3V.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatacaagtatgtccttcccagttcccttctccgtacggggtcccctggtacggttcaggtcggctaggtggatcgtagggactactatttccaccctcaccatacaatacgcctaggaacgcgtagaagatgactagactaactttattactcgtacatcaagtaacttacttactttacctactaacgtgtaactcctaacccgtttaccggaaccgtaacgggacctaacgacgtaggtaacgtaagttaaaaccgg

SEQ ID NO: 171995 - DNA, 717 bp, Homo sapiens
  misc_feature: GYAE6OF02IULG2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtggacactactttccaccctcaccatacaatacgcctagggaacgtcgtagaaagtactacggcctacggtacctaaaccttttactttaccgttcggttacctaattaccgaaacggttaaaccggtttaacccgtttaaaccctttttaaccccgttaaccgttaaacgggtttcgtaaacgtttacccgtaaaccccggttttacccggggaccccgttaaaacggggggacccttaaacccggggtaccgttaaggggtaaaccggtaaacgttttaaaaacccgggtaacgtttacgggtacgggttacccgttacggtacccctaacccgttacgttaccggtttacggttacccgtttacccg

SEQ ID NO: 171996 - DNA, 515 bp, Homo sapiens
  misc_feature: GYAE6OF02IATDP.27.78.H01.1.454.CMB.1.raw
  modified_base (378)..(378): a, c, t, g, unknown or other
  misc_feature (378)..(378): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctctcatcaagtatgcttcccagtccttctcacgggtccctcgaggttcagtgcagtgatcgtggacactattccacctcaccatcaatcgactagganctagaagatgctgactaattatactgtacatcaagactactacttacctnaagtnactcaccttggaccaaggaccacgactggataagttaaaccgacgttgtaggcctggaccaaccgtatcttaggtcttaccg

SEQ ID NO: 171997 - DNA, 662 bp, Homo sapiens
  misc_feature: GYAE6OF02G6R6N.27.78.H01.1.454.CMB.1.raw
  modified_base (149)..(149): a, c, t, g, unknown or other
  misc_feature (149)..(149): n is a, c, g, or t
  modified_base (250)..(250): a, c, t, g, unknown or other
  misc_feature (250)..(250): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttaacncgtggtaccagcagaacgccaggtcagtctaccaaagctcctcatcaagtatcgccttcccagttccttctccgtaccggggtcccctcggtacggttcagtcggcaggtcggatcgtagggacactatttccaccctacaccctatactaaatacgcctaggaacgacctaggaacgtatcgctcgactaactttacttactgtactactacgtaagtacgttaacctttaaccgtttaaccctacgtaaagtcggtaacttaccgtaacccggtttaccggaacccgaaacgggtaccgtaaccggtaacgttaacggggtaaacggttaaacgttaaaaccggtaaccggtttacgggtacggtaccgttaacggtacccgtaacccttacgttccgttacggttaccc

SEQ ID NO: 171998 - DNA, 630 bp, Homo sapiens
  misc_feature: GYAE6OF02JRMYN.27.78.H01.1.454.CMB.1.raw
  modified_base (332)..(332): a, c, t, g, unknown or other
  misc_feature (332)..(332): n is a, c, g, or t
  modified_base (550)..(550): a, c, t, g, unknown or other
  misc_feature (550)..(550): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtagtaaattgtgctgactcagtctccagtacttcagtctgtgactaccaaaggagaaagtcacatccacctgccggccagtcagagtcgttggtagtagtcgttacacgtcgtaccagcaagaacgccaggtcacgtcctaccaagtcctcctanactacgaagtatcgccttccgacgttccttccgtacgtccgggtccctgtaccggttcaaggtgtcctaggtcggattcgtcgggtacacgttactttccacccttacaaccgtactaccaagtaccgaccttaggacgtacctagaacgtactgaccgtgtaccgttaacttagttactgtacaacgtcgaagtacgtactttaaccttacccgtanacggttcgattaccgtaccgttacggaacccgtaacgggtaccgtaccgtaacggtaacggacgttaacgttaaaaccgg

SEQ ID NO: 171999 - DNA, 590 bp, Homo sapiens
  misc_feature: GYAE6OF02F4IRG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcacgggtcccctcgaggttcagtggcagtggatcgtgggacactatttccaccctcaccatactaatacgccgttggaaacgcttagaaagatgctagactaacgttacttactgtacatcaagtacttaccttactttaccgactaagtgtacttccgtaaccgtttccggaaccgtaaagggaccaacggtacgtacgggaagttaaacgttaaaaccggtacttggttacggacgtacggtaccaccgtaacgttaccgttcgttacctttaccg

SEQ ID NO: 172000 - DNA, 523 bp, Homo sapiens
  misc_feature: GYAE6OF02HMRS9.27.78.H01.1.454.CMB.1.raw
  modified_base (442)..(442): a, c, t, g, unknown or other
  misc_feature (442)..(442): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgacggttcagtggcagtggatctgggacacatttcaccctcaccatcaatagcctaggaacgctagaagatgctgactaacttattactgtcatcagtacgtacttactttaccncaagtgattccaccgttcgaccgtaacggacacgctaggaacgtaattaaacgaattgagctacgacaccattctgttacc

SEQ ID NO: 172001 - DNA, 521 bp, Homo sapiens
  misc_feature: GYAE6OF02HS6PZ.27.78.H01.1.454.CMB.1.raw
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcaggtggatctgggacacactttcaccctcaccatacaatacgcctaggaancgtagaagatgctgactaacttatactgtcatcagatacttactttacctatagtgactcaccttcggaccaaggacacgacgtggaagtaattaaacggaactggtacgctgaccacctatctgttcttac

SEQ ID NO: 172002 - DNA, 609 bp, Homo sapiens
  misc_feature: GYAE6OF02I4CW9.27.78.H01.1.454.CMB.1.raw
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccgaaaggagaaagtcaccatcacctgccgggccagtcagagcgttggagtagcttacactggtaccagcagaagccaggtcagtctacaaagcnctcatcaagtatgccttcccagtcccttcncgtacggggtcccctaggacggttcaggtggacaggtggatcgtagggactactactttccacccttcaacccatacctaaagtacgaccgtaggaaacgtcctaagaacgatcgcgtgacctaaacttattacgtgtactatcgtaagtacgttaaccttaacctttaccgtactaacgtataacttacccgtaaccgttccggaacgtaaacgggactaaccgtacgtacggaagtaacgttaaaccggtacgttaggtcggtacacggtaccaacctacgtactcgttactac

SEQ ID NO: 172003 - DNA, 518 bp, Homo sapiens
  misc_feature: GYAE6OF02F1TK0.27.78.H01.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (440)..(440): a, c, t, g, unknown or other
  misc_feature (440)..(440): n is a, c, g, or t
  modified_base (508)..(508): a, c, t, g, unknown or other
  misc_feature (508)..(508): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctggactcagtctccagactttcagtctgtgactccaaaggngaaagtcaccatcacctgcccgggccagtccagngcgttggtagtagcttacactggtaccagcagaagccaggtcagtctccaaagctcctcatcaagtatgcttcccagtccttctcacgggtccctcgaggttcagtggcagtggatcgtggacactatttccaccctcaccatcaatagccgtaggaacgctagaagatgctgctaacttattactgtcatcagacgtactacttaccanaagtgatcaccgttcgaccaagggaccacgactaggagtaattaaacgaacgtgacgtctgcaacctntctgtcttac

SEQ ID NO: 172004 - DNA, 643 bp, Homo sapiens
  misc_feature: GYAE6OF02FYAGL.27.78.H01.1.454.CMB.1.raw
  modified_base (151)..(151): a, c, t, g, unknown or other
  misc_feature (151)..(151): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttgggggcgagtgagcaaaacgtgacaagtcaaggcaggaagatgttgccatcacaactcattgggtttctgctgctctgggttccagcctccaggggtnaaattgtgctgaactccagtctccagtactttcagtctgtgactccgaaaggcaaagtcacatcacctgccggcagtcagagcgttgagtagccttacnctgtaccagcagaacgccaggtcagtctccaaagctcctcatcaagtatgccttcccagtccttcncgacggggtcccctcggtaggtttcaggttcgggccgtaggtcgggacttcggtaggggacctacgtactttcccacccgttcaccctactaccaagtacgcctaggaacgtcctagaacgtactcgactagactaacgtttacttacgtcggtacacgtacgaacggtacgttaaccttaacctttacctagtaacggttntacttaccgtaccgttccggaaccgaacgggaccacggtaccgtaggtaaacgttaacgttaaaccggaacgtttcggttaacggccgttacggaccctaacctacgtttaccgttacgtttccc

SEQ ID NO: 172005 - DNA, 605 bp, Homo sapiens
  misc_feature: GYAE6OF02JOYW0.27.78.H01.1.454.CMB.1.raw
tcagagcgtcgtctcacgaccggtgctcgatttagtgtgagtagtttgggtttggggggcgatgagcaaaactagacaagtcaaggcaggaagatgttgccatcacaactcattgggtttctgctgctctgggttccagcctccaggggtgaaattgtgctgactcagtcctcagactttcagtctgtgactccaaaaggagaaagtcaccatcacctgcccgggccagtcagagcggttgggtagtagcttacactggtaccagcagaagccagtcagtctaccaagcctctcataccagtactgccttcccatcccttctcgacgggtcccctcgtacggttcagtggctaggtggtatcgtggggactactacgtttaccacccgttcccacctaactctaaacgtacgtccctagggaacgcttagaacgattgactgacctaactttaattaccttgtcatcaagacttaacttaccttacctctaagtcgaacttacctaccttaccggccgtaaacggaccgacgtacgtacgggaaggttaaccttaaacggaaccgttcggtacggtctacggcctaccgtacttcgtacttaccg

SEQ ID NO: 172006 - DNA, 659 bp, Homo sapiens
  misc_feature: GYAE6OF02I4V5I.27.78.H01.1.454.CMB.1.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttcncacgggtccctcgagttcagtgcagtgatcgtggacacattccaccctnaccataccaatacgtcctaggaactctacggaagtactcggtacctaggaccttaaaacgtttactttaaccgtggttacctaagttcccgtaaaggttaacgtttaaaccctttaaacctttttaaccctacgtaaaggttactaacttacccgtaaaccccggttttcggaaccccggtaaaaacggggacctaaacccggtaccgttgggaaaccgttaaagtttaaaaacccgcgttaacggggtacggtacttacggaccctaaaccggtacttaccgttacggttactttaccc

SEQ ID NO: 172007 - DNA, 557 bp, Homo sapiens
  misc_feature: GYAE6OF02IG1XQ.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaacgccaggtcagtctaccaaagctcctcatacaagtatcgcttcccagtcccttctcgacggggtccctcgtagttcgagtgctagtgactcgtagggactaaactttccaccctacacctatacaactacgaccgtaggaacgtcgtagaagatcgactacgactaactttattactagtcatcaagtatactacttactactagtgtactcctaccgtacggaccaagggaccacggtacgtaggaacgtacttaacgtaacg

SEQ ID NO: 172008 - DNA, 565 bp, Homo sapiens
  misc_feature: GYAE6OF02GWTS5.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacgggtcccctgacggttcagtgcagtgatcgtggacactatttcaccctcaccatacaatacgccgtaggaacgctagaaagtatgctgactaacttattactgtacatcgagtagtaccttaactttacctacgtaacgtagactaccgtaccgtttaccggaccgaagggaccacgtacgtggaacgtaacgttaaaaccgacgtggtacggtcgtacgacctaactacttcgttcgttacttaccg

SEQ ID NO: 172009 - DNA, 575 bp, Homo sapiens
  misc_feature: GYAE6OF02H8GUD.27.78.H01.1.454.CMB.1.raw
  modified_base (197)..(197): a, c, t, g, unknown or other
  misc_feature (197)..(197): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcactgccggcagtcagagcgttggtagtagcttacactggtaccagcagaagccaggtcagtctaccaaagctcctcatcaagtatgccttcccagttccttctcgtacggggtcccctcgtacggttcgacgtggctaggtggatcgtcgggactaactatttccaccctcaccatacaatacgcctggaagctagaagtatgcngactaacttattacngtcatctagattaccttactttacctactagtgtacctcgtacccgtttcggaccgaaacgggacacgtacgtggtaagtaacgttaaaaccgacgttaggtacggtacttacggacctaacctacttccgttacgtccttacccg

SEQ ID NO: 172010 - DNA, 540 bp, Homo sapiens
  misc_feature: GYAE6OF02GCUF1.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatcgtgggacacatttccaccctcaccatccaatacgcctaggaagctagaagatgctgactaacttattactgtcatcagtagtacttactttacctactaagtcgatccaccttcggaccgaacgggacacgactagggaagtaacgttaaaccgaacttggtacggtactcggaccaccattccgtgttaccc

SEQ ID NO: 172011 - DNA, 535 bp, Homo sapiens
  misc_feature: GYAE6OF02G91F6.27.78.H01.1.454.CMB.1.raw
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (449)..(449): a, c, t, g, unknown or other
  misc_feature (449)..(449): n is a, c, g, or t
  modified_base (520)..(520): a, c, t, g, unknown or other
  misc_feature (520)..(520): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcacggggtcccctcgacggttcagtggcagtggatcgtgggactacgtatttccaccctcaccatcaatgcctaggaacnctagaagntgctgactaacttattactgtcatcagtacgtacttactttaccactagtntactctacccttcggaccgaagggaccacgacgtggaagtaagtaaacgactcggtaggcctgcctaaccnttcgtcgtcttaccg

SEQ ID NO: 172012 - DNA, 510 bp, Homo sapiens
  misc_feature: GYAE6OF02HF7D4.27.78.H01.1.454.CMB.1.raw
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtccctgacgttcagtgcagtggatcgtgggacacatttcaccctcaccatcaatagcctggaagctagaagatgctgactaacttattactgtacatcagacgtacttacttacctcagtnatccaccttcgaccgaagggacacgactggatataaacg

SEQ ID NO: 172013 - DNA, 667 bp, Homo sapiens
  misc_feature: GYAE6OF02G1COH.27.78.H01.1.454.CMB.1.raw
  modified_base (201)..(201): a, c, t, g, unknown or other
  misc_feature (201)..(201): n is a, c, g, or t
tcagagcgtcgtctcacgaccggtgctcgatttagtgtgagtagtttgggtttggggggcatgagacaaaactgacaagtcaaggcaggaagatgttgccatcacaactcattgggtttctgctgctctgggttccagcctccgaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagcctcctcatcaagtatgccttcccagtcccttctccgacggggtcccctgtaggttcaggtggcaggtggatcgtgggacacgtatttccaccccttcaacctataccaaatacgcccttagggaacgcttaggaaacgtatcgctgacctaaactttatttaaccgtgttaccattaccgaaggtaacgtttaacctttaacccgtttttaaccctacgtaaacggttacgtaactttacccgtaaccccggtttaccggaacccggtaaacggggtaccacccggtaacttaggggaaaccgttaacgtttaaaaaccggtaacgttaggtacggtaccttcgggaccctaacccgtacgtttaccgttacggttaccc

SEQ ID NO: 172014 - DNA, 633 bp, Homo sapiens
  misc_feature: GYAE6OF02GNWWU.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttccagttccttctcacggggttcccctggtaggttcagtcggcaggtggatcgtcgggacactatttccacccctcaacccataccaaatacgccctagggaaacgccttaggaaacgtagttgaccgttgacctaaactttacgtttaacttcggtacaacttaccgtaaggtaacgtttaacccttaaccttttaccctacgtaacggttcgtaaccttacccgtaacccgtttaccgggacccgtaaacggggacccaaaccggtaccgtacggggtaacgtaacctttaaaaccggg

SEQ ID NO: 172015 - DNA, 545 bp, Homo sapiens
  misc_feature: GYAE6OF02H9TWI.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagactttcagtctgtgactccaaaggngaaagtcaccatcacctgccgggccagtcagagcgttggtagtagcttacactggtaccagcagaagccaggtcagtctaccaaagctcctcatcaagtatgccttcccagtcccttctctacggggttcccctcggtacggttcaggtcggcaggtggatcgtggggacacgtatttccaccctcaccatcaatacgcctaggaagtctagaagatgctgactaactttattactgttcatcaagagtacttacttttacctactaagtgactctaccgttcggacaaacgggacacgacgtaggaagtaacttaacgactggtcgctacgcaccatcttcgtcttac

SEQ ID NO: 172016 - DNA, 582 bp, Homo sapiens
  misc_feature: GYAE6OF02HGSGG.27.78.H01.1.454.CMB.1.raw
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcacgggtccctcgaggttcagtggcagtgatcgtgggacacatttcaccctcaccatcaatagcctaggaanctgaagatgctgctaacttattactgtcatcagtacgttacttactttaacctcgtaagtcgtacttaccctaccgtttaccggaccgtaacggggacccacgggtaaccgtacgggaaacgtaacgtttaaaaccgggaacgtttacgggttacgggtactcggaccctaacccgtacttaccgttcggtttaccc

SEQ ID NO: 172017 - DNA, 584 bp, Homo sapiens
  misc_feature: GYAE6OF02I9MXW.27.78.H01.1.454.CMB.1.raw
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagagcgtcgtctcacgaccggtgctcgatttagtgtgagtagtttgggtttgggggagtgagcaaaactgacaagtcaaggcaggaaaatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctaccaaagctctcatcaagtatgcttcccagtccttcncgcgggtcccctcggtagttcaggtgcagtggattcgngggaccacgtntttccaccctacaacctactacaaacttcggcctaggaacgcttagaaacgtagtacgctacgactaactttactaacttntacntactagagttaccttaactttacctataagtcgtatacctaccgttccggaccgaaaggaccaacgtcgaggtaagtaacttaaaccgtaacgttggacgtcacgtaccaccgtatcgttcgttacgttcctaccg

SEQ ID NO: 172018 - DNA, 577 bp, Homo sapiens
  misc_feature: GYAE6OF02GWIUJ.27.78.H01.1.454.CMB.1.raw
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctcccaaagctcctcatacaagtatgccttcccagtccttctcgacggggtccccctggtaggttcaggtggcaggtggatcgtgggacactactttccaccctcaccatacaatacgcctggaacgtctaggaagatgctcgactaaacttattactgtcatcaagtacttaccttaactttacctactaagtactactactacccgttacggaccgaacgggaccacggacgtaggaacgtaacttaaaccggtacgtaggtacggtcgtacgccgtaacctacgttactcgtccttaccg

SEQ ID NO: 172019 - DNA, 607 bp, Homo sapiens
  misc_feature: GYAE6OF02HJ0HK.27.78.H01.1.454.CMB.1.raw
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactacaaagagaaagtcacatcacctgccgggccagtcagagcgttggtagtagcttacacgtggtaccagcaagaagccaggtcagtctaccaaagctctcatacaagtatgccttccagtccttctcgacgggtccctgtagtcagtggcagtgatcgtaggacnctacgttccacctcaccatacaagtacgaccgtaggaatcgtagaatatgctagacctaaatttagttacgtnactaactcgtaaaggtacttaaccttaacctttaacccgtactaaagttcgtaacttacctaaccccgtttccgggaaaccaacggggaacctaccgggtaacgtacgggaaagttaacttaaaacggtaactaggggtaccgttacgacggtaccaacccgttattccgttacgttacc

SEQ ID NO: 172020 - DNA, 729 bp, Homo sapiens
  misc_feature: GYAE6OF02GU810.27.78.H01.1.454.CMB.1.raw
tcagagcgtcgtctcacgaccggtgctcgatttagtgtgagtagtttggggtttggggatgagcaaaactgacaagtcaaggcaggaagatgttgccatcacaactcattgggtttctgctgctctgggttccagcctccaggggtgaaattgtgctgactcagtctccagtactttcagtctgtgactacaaggagaagtcacatcactgccgggcagtcagagtcgttggtagtagcttacacgtggtaccagcagaacgccaggtcagtctaccaaagtctcctacactacaagtatcgtaccttccgacgttccttctcggtaccgggtccctacggtacggttcgacggtggcgtagtgactcgtaggacacgtacttaccacctacgactactactaacgtacgaccgtagggaacgtcgtagaacgtagtcgaccgttagaaccgttaactttaacgttaaccgttcgtacgtaacgttacgtaaacgggttaactttaaacccgtttaacccgtttaacccgtaacgttaacgggttaacttaaccgttacccgtttaacccgggtacccgggtaaccggtaaacggggacccttaacgggtaacgggttaggggtaaacgtaaacccggttaaaaccggtaccggttcgggttaaccgggtaccgtacggtaacccgtaaaccggttacggttacccggtttacggttaccctttaaccg

SEQ ID NO: 172021 - DNA, 538 bp, Homo sapiens
  misc_feature: GYAE6OF02HU03S.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacggggtcccctcggagttcagtggcaggtggatcgtgggacactatttccaccctcaccatacaatacgcctaggaagctagaagatgctgactaacttattactgtcatcagtagtactactttacctataacgtgtactctaaccgttccggaccgaagggaccaacgacgtacggagtaattaaacgg

SEQ ID NO: 172022 - DNA, 503 bp, Homo sapiens
  misc_feature: GYAE6OF02FI3EE.27.78.H01.1.454.CMB.1.raw
  modified_base (198)..(198): a, c, t, g, unknown or other
  misc_feature (198)..(198): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccatgggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatctgggacacatttcaccctcaccatcaatacgcctagganctgaagntgctgctaacttattactgtcatcagagttactactttacctnaagtgactcaccgttcgaccaagggacacgacgtggagaataacgagtgtggctgcacctatctacg

SEQ ID NO: 172023 - DNA, 559 bp, Homo sapiens
  misc_feature: GYAE6OF02IILMN.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttccagtccttctcacgggtccctgagttcagtgcagtgatcgtgggacacactttcaccctcaccatacaatacgcctaggaacgctagaagatgcctagacctaacttacttactgtactatcgaagtacgttaccttactttaccctagtaacgtcgtacttacgtacccgttacggacccgtaacgggtaccaaccggtacgtacggacgtaacgttaaaaccgg

SEQ ID NO: 172024 - DNA, 534 bp, Homo sapiens
  misc_feature: GYAE6OF02ICORA.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgcttcccagtccttctcacggggtcccctcgaggttcagtggcagtggatcgtgggacacatttccaccctcaccatcaatagcctggaacgctagaagatgctgactaacttattactgtcatcagacgtacttactttacctactaagtcgatcctaccgttcggaccaagggacacgactaggataacgttaaacgaacgttgtaggctacggccacctattcctgttccc

SEQ ID NO: 172025 - DNA, 546 bp, Homo sapiens
  misc_feature: GYAE6OF02GZUGR.27.78.H01.1.454.CMB.1.raw
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgtaggttcagtggcagtggatcgtgggacacgtatttcaccctcaccatacaactacgcctaggaacgctagaagntgctgacctaacttattactgtcatcagtatactactttaccncgtaagtgacttccaccgttcggaccaacgggacacgtacgtaggaagtaacttaaacgaacttgtacggctacggacctacctacgttcgtacgttcc

SEQ ID NO: 172026 - DNA, 527 bp, Homo sapiens
  misc_feature: GYAE6OF02GE4BM.27.78.H01.1.454.CMB.1.raw
  modified_base (385)..(385): a, c, t, g, unknown or other
  misc_feature (385)..(385): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcaggtggcagtggatctgggacacatttcaccctcaccatcaatagcctggaacnctagaagatgctgctaacttattactgtacatcagtagtactactttaccnaagtgatccaccttcggaccaagggaccacggactggagtaacttaaacgacttggtaggtctacgccaaccgtactcgtcgttcttaccg

SEQ ID NO: 172027 - DNA, 555 bp, Homo sapiens
  misc_feature: GYAE6OF02I5VTR.27.78.H01.1.454.CMB.1.raw
  modified_base (383)..(383): a, c, t, g, unknown or other
  misc_feature (383)..(383): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggttaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttccagtccttctcacggggtcccctcggacgttcagtggcaggtggatcgngggacacgactttcaccctcacccatcaattagcctaggaacgcgtagaagatgctgactaattacttactgtacatcagtacgttactacctttacctctaaggtgtaactacctaccgttcggacccgaagggaccacggtaactgggaacgtaacgttaaacgtaacgg

SEQ ID NO: 172028 - DNA, 535 bp, Homo sapiens
  misc_feature: GYAE6OF02I3B6P.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacactatttccaccctcaccatcaatacgcctaggaagctagaagatgctgactaacttattacctgtctatcagtacgttacttaactttacctactaagtctactcctaccgttcgaccgtaagggacacgacgtaggaagtaagttaaacgaagtgtacgctcgacaccgtatctgtcttac

SEQ ID NO: 172029 - DNA, 556 bp, Homo sapiens
  misc_feature: GYAE6OF02IG3SY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttccagtccttctcgacggggtcccctgaggttcagtgacaggtcggatcgtgggacactactttccaccctccacactacaatacgcctaggaacgctaggaagtatacgctacgactaacttacttactgtctactcgagtacgttaacttactttacctactaagtctactacctacgttaccgaccgtaaggacctacgacgtaggacgtaacgttaaaccgg

SEQ ID NO: 172030 - DNA, 551 bp, Homo sapiens
  misc_feature: GYAE6OF02ICHZD.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactccaaaggagaaagtcaccatcactgccggaccagtcagagcgttggtagtagcttacactggtaccagcaagaagccaggtcagtctaccaaagctcctcatcaagtatgccttccagttccttctcgacgggtcccctcgaggttcagtggcagtggatcgtaggacacgtatttccaccctcaccatacaatacgcctaggaacgtctagaagatcgctgactaactttacttactgtcatcagacttaactactttacctactatagactacctaccgttacggaccgaaggaccaacggtacgtaggacgtaacgttaacgtaacgg

SEQ ID NO: 172031 - DNA, 546 bp, Homo sapiens
  misc_feature: GYAE6OF02HTKP3.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggcagtcagagcgttggagtagcttacactggtaccagcagaagccaggtcagtctccaaagctcctcatcaagtatgcttccagtccttctcgagggtcccctgaggttcagtgcaggtgatcgtgggacacgtatttccaccctcaccatcaatacgcctaggaacgcagaagatgactgacctaacttatactgtacatcagtagtaccttactttacctacgtaagtcgaattccaaccgtttccggacccgaacggtaccaaccgtacgtacggtacgaagttaaaaccgg

SEQ ID NO: 172032 - DNA, 506 bp, Homo sapiens
  misc_feature: GYAE6OF02I78YJ.27.78.H01.1.454.CMB.1.raw
  modified_base (406)..(406): a, c, t, g, unknown or other
  misc_feature (406)..(406): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaactttntactgtcatcagtacgtactactttacctcaagttgacttcaccttcggaccaagggaccacgactaggagattaaacgactgtggctgccacatctgtc

SEQ ID NO: 172033 - DNA, 582 bp, Homo sapiens
  misc_feature: GYAE6OF02G1JR0.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagttccttctcgacggggtccccctacggtacggttcagtcggcaggtggatcgtgggacacatttccaccctcacctatcaatacgcctaggaacgctagaagatggtctgactaactttataacttgtacatcagtagtacttactttaccagtaacgtgaacttcctaaccgtttccgggaccaaacggggaccaaccggacgttagggaagtaacgttaaaaccggaacgttggtacggacgtacgacctaacccgtagttcccttagtccttacc

SEQ ID NO: 172034 - DNA, 627 bp, Homo sapiens
  misc_feature: GYAE6OF02JEPQ7.27.78.H01.1.454.CMB.1.raw
  modified_base (226)..(226): a, c, t, g, unknown or other
  misc_feature (226)..(226): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactacgaaaggagaaagtcaaccatcaccgtggccgggaccngtcaggagcgttaggtagtagacttacgacgtcggtaaccagacgaagaacgaccgaggtacgtacaggtaactcctaaaacgctaacctcaaagttcaagtactacgacttccctaagtccgttacggtccaagggggttccccttacggacggtttcaaggttcggacgtagtcggaagtctagggtactacgacttacaacctcaccatcgaacgtagacctaggaaacgacgtagaacgtatacgactagactaacttattactagtacatactagtacgttactacttacgtactaagtcgtacgttcgaaccgttacggaacctaaggacacgaacgtacggtaagtaacgttaacgaacgttacgacgtactacgacgtactacgtactagtac

SEQ ID NO: 172035 - DNA, 558 bp, Homo sapiens
  misc_feature: GYAE6OF02GKC1F.27.78.H01.1.454.CMB.1.raw
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccgaggtcagtctaccaaagcctcctcatacaagtatcgcttcccacgttccttctcgtacgggtcccctgacggttcagtggcaggtgtactcgtgggacactacttccaccctcaccatacaatacgacctaggaacgcgtacgaanagtgactgtactaactttactacttgtctatcgactacgttaaccttacctttacctactaagtctactcctaccgttcgaccgaacggacgacgtacgagtacgtaagtaacg

SEQ ID NO: 172036 - DNA, 512 bp, Homo sapiens
  misc_feature: GYAE6OF02JDF8Z.27.78.H01.1.454.CMB.1.raw
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcccaaagctcctcatcaagtatgcttcccagtccttctcaggggtccccctcgaggttcagtggcagtggatctgggacacatttcaccctcaccatcaatagcctggaagctgaagatgctgcaacttattactgtcatcagagtactactttaccnctaagtnatcaccttcggaccaagggaccacgactggagtacttaaacgactgtggctggacacctatcctgtcttaccg

SEQ ID NO: 172037 - DNA, 595 bp, Homo sapiens
  misc_feature: GYAE6OF02IXCNE.27.78.H01.1.454.CMB.1.raw
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggagtagcttacactggtaccagcagaagccaggtcagtctaccaaagctcctcatcaagtatgcttcccagtccttctcgacgggtcccctcgtaggttcagtcggcagtggatctgggacacatttccaccctcaccatacaatacgcctaggaacncctagaaagtntgctcgactaacgttacttacttgtactatcaagtacgtaccttaactttaacccgtctaagtagtacttaccctaccgtttaccggacctaaacggggaccaacggtaccgttacggaacgtaacgttaaaccggtaacgtcggttacggaccgttacggacctaacccgtatccgttacgttcctttaacccg

SEQ ID NO: 172038 - DNA, 769 bp, Homo sapiens
  misc_feature: GYAE6OF02GWWQA.27.78.H01.1.454.CMB.1.raw
  modified_base (287)..(287): a, c, t, g, unknown or other
  misc_feature (287)..(287): n is a, c, g, or t
tcagagcgtcgtctcacgaccggtgctcgatttagtgtgagtagtttgggtttggggtagtcttaaagaaggttctttcttctggagtgtggcatgagcaaaactagacaagtcaaggcgaggaagatgttgccatcacaactcattgggtttctgctgctctgggttccagcctccaggggtgaaattgtgctgactcagtctccagactttcagtctgtgactccaaaaggagaaagtcaccatcgacctgccgggccagtcagagcgtggtagtagctactacngtaccagcagaagaccgaggtccgagtacctccaaaacgtctcctcatccaagtatcgaccttcccacgttaccttcctcagggggttccccctcggtacggttcaagtgggccgagtacgggtatcgtacggggtacaactaactttccaccccctcaaccccgtaacttaccgtaaataaaccggtaccccgtggggtaaacgtacccttagggtaaaacgtaacgtacgggttccgttaacgggtcccgttaaaaactttttaaacgttttaacccgtttaggtttaccccaagttacctaaaccggtttaaacgttaaccctttaaccgtttttaaccccttaaaccttaaaccggtttacggaaccttttaacccgaacccccggttttaccgggtaaccccgttaaaccggggggaaacccgttaaaccggtaaccccggttaaggggtaaccggtaagtttaaaaaaaccccggg

SEQ ID NO: 172039 - DNA, 501 bp, Homo sapiens
  misc_feature: GYAE6OF02GN5X8.27.78.H01.1.454.CMB.1.raw
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatctggacacatttcacctcaccatcaatgcctggaagctagaagtatgctgactaacttattactgtcatcanacgtactacttactanaagtgatctacttcggaccaaggcacgacngagaataaacgacgtgtgctagcaccgtatcgtgtctac

SEQ ID NO: 172040 - DNA, 567 bp, Homo sapiens
  misc_feature: GYAE6OF02ITBOB.27.78.H01.1.454.CMB.1.raw
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcgccaaagctcctcatcaagtatgcttcccagtccttctcacgggttcccctcgtaggttcagtggcaggtggactcgtgggacacgtatttcaccctcaccatcaatacgcctaggaacgctagaagatgctgactaacttattactgtacatcaagacgttacttactttaacctntaagtcgtattacctaccgttacggaccgtaagggaccacggtaacgtcgggtaaacgtaacgttaaacgaacttaggtacggtacgtcgaccgtaacctattccgtgttaccc

SEQ ID NO: 172041 - DNA, 600 bp, Homo sapiens
  misc_feature: GYAE6OF02HVI7F.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatccacctgccgggccagtcagagcgttggtagtagcttacactggtaccagcagaagccaggtcagtctccaaagctcctcatcaagtatgcttcccagtccttctcacggggtcccctcggacggttcagtggcagtggatcgtgggacacgtatttccgacccttcaccctaatccaaatacgccttaggaaacgtcgtaggaaagatgctagctaaactttattacttgtactagtcaagactttaactactttacctacgaagtcgaattccgtacctttacgggaccgtaaagggaccaacgtactagggaacgtaaactttaaaaccggaacttaggtacggtaccctaggaccctaacccgtagttaccgttgttaccctttaccg

SEQ ID NO: 172042 - DNA, 573 bp, Homo sapiens
  misc_feature: GYAE6OF02GQ8W2.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtcccttctcgacggggtcccctcggaggttcagtggcaggtcgatcgtgggacactatttccaccctcacctatacaatacgcctaggaacgtctagaagatgctgacctaactttacttactgtacattcgagtaacgttaaccttacctttacctctaaggttcgaacttccctaaccgttcccgggaccaacggggaccaaccggtaacgtaggtacgtaacttaaaccgg

SEQ ID NO: 172043 - DNA, 725 bp, Homo sapiens
  misc_feature: GYAE6OF02HVF63.27.78.H01.1.454.CMB.1.raw
  modified_base (163)..(163): a, c, t, g, unknown or other
  misc_feature (163)..(163): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggttggggggcatgaggcaaaactgaccaagtcaaggcgaaggaagagtgtttcgcctagtcacaactcattggtttctagctgcgtctgggttcccagccgtccgtagggggtnaaattggtgtcgttcgacttcgagttccttacgaggtacttttcagttctgtggactccaaaaggcgtaaagtcaaccgtagtcggaccgtcggccgggccaggtccagggaggtccgttaggtacgtacgtcttacgacgtggtaccagtcgaagtaacgccgtaggtcctagtcctactaaagtcctcctactagtaccaaggtactcggtccttacccgaggtcctttacggacggtacggggtcccctaggtaggttcaggtcggntagggtagtacgtcgtacgggactaaacgtctttaccaccctacaaccgtatacgaaacggtaccgccgttacggaaacgtctaaggaacgagtaggactacgtaaccttaaacgttaaccgttacgtcgtactacgtacgtacgtaacgttaacttaccgtttaacacgtaactaggactaccgttaaccggtacggaaccgtaaggaccgtacgtaggttacggaacgttaaacgtaacggaacgttcggtacggacgtagacccgttaacgtacgttacgtacgttacg

SEQ ID NO: 172044 - DNA, 724 bp, Homo sapiens
  misc_feature: GYAE6OF02GWDRK.27.78.H01.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (430)..(430): a, c, t, g, unknown or other
  misc_feature (430)..(430): n is a, c, g, or t
  modified_base (556)..(556): a, c, t, g, unknown or other
  misc_feature (556)..(556): n is a, c, g, or t
tcagagcgtcgtctcacgaccggtgctcgatttagtgtgagtagtttgggtttggggagtcttaaaagaggttctttctctgggatgtggcatgagacaaaactgacaagtcaaggcaggaagatgttgccatcacaactcattgggtttctgctgctctgggttccagcctccgagggtgaaattgtgctgactcagtctccagtactttcagtctgtgactaccaaaggagaatccacatcaccgnggccggccagtcagagtcggttggtagtagtcttactacgnggtaccagcgaagaacgccgaggtccgtactaccaacgactcctcatacaagtacgtgtacctcctaccgtcctttcctcggtaaccgggttccccgggttacccgtaggttacggtacgtacgggtccgaggttacgggnggtaacctcgggaacgaaccttaactttccctacccaccctaccgaactaactaacgtaacgctacggaacgactacggtaaagacgtctacgtacctaaccgtaacttaaactttcgtaccgttnacgtaactaaccggtaaagttttaaccccttaaccgttttaaccgttaccaacgggttaacgtttaacgaccccgtttacccggttaaccccgggtaacggaaacccgggtaaacccggaccgttaagtaacccggtaaaggttaaacgttaaacccgttaaaacggg

SEQ ID NO: 172045 - DNA, 728 bp, Homo sapiens
  misc_feature: GYAE6OF02H03QH.27.78.H01.1.454.CMB.1.raw
  modified_base (326)..(326): a, c, t, g, unknown or other
  misc_feature (326)..(326): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggagtagcttacactggtaccagcagagccaggtcagtcctaccaagcctcctcatcaagtntcgtccttcccagttcccttcgtacgaccggggtcccctaggtacggttcaggtcggaccgtaggtacggacttcggtacgggtaactaccttacttttaccccaacccgtcctaaccctaagtaccaaacgttaccggtacccgttaagggaaacgtaccgtaaggtaaacgtacgttacgtaccgttacggttaacctttaaaccgttttactttaaccgttcgttaaccctaagtttaaccgtaaagttaaccgtttaaccctttaaccttttacccgtaacgttaaccggttaacgtaacctttaccccggttaacccggtttaacccggaacccggtaacgggtaacccgaaccggtaaccggttaacgggtaacgttaaaccgtttaaaacccggg

SEQ ID NO: 172046 - DNA, 571 bp, Homo sapiens
  misc_feature: GYAE6OF02FQ9JA.27.78.H01.1.454.CMB.1.raw
  modified_base (320)..(320): a, c, t, g, unknown or other
  misc_feature (320)..(320): n is a, c, g, or t
tcagagcgtcgtctcacgaccggtgctcgatttagtgtgagtagtttgggtttgggggatacttaaaagacggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctaccaaagctccncatcaagtatgcttcccagttcccttctccgacggggtcccctggtacggttcagtcggctaggtcggactcgtgggactacgtactttccaccctcacctactacaatacgacctggaagctagaagatgctgacctaacttacgttactgtactatcgaagtagtaccttactttacctacgtaaagtgtactccgtaccgttccggaccgtaacggacctaccggaccgtaggacgtaattaaaccgg

SEQ ID NO: 172047 - DNA, 525 bp, Homo sapiens
  misc_feature: GYAE6OF02HELZ5.27.78.H01.1.454.CMB.1.raw
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctgaggttcagtggcagtggatcgtggacacatttcaccctcaccatcaatacgcctggaagctgaagatgctgctaacttattactgtcatcagtagtactactttacctntaagtgacttcaccgttcggaccaagggacacgacgtggaacgtaagttaaaccgagtgtaggtactcggacacctatccgttagtccttacg

SEQ ID NO: 172048 - DNA, 595 bp, Homo sapiens
  misc_feature: GYAE6OF02GCOXM.27.78.H01.1.454.CMB.1.raw
  modified_base (457)..(457): a, c, t, g, unknown or other
  misc_feature (457)..(457): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctacatacaagtatcgccttcccagtccttctcgtacggggtcccctgacggttcagtggcaggtgatctgggacactctttcaccctcaccatacaactagcctaggaacgtctagaaagtatgctacgactaaacttattactgtcatcaagtacgtaccttactttacctanaagtgaacttccgtaccgtttacggaccgaaacgggaccaccggtacgtacgggtaacgtaaacgtttaaaaccgaacgttcggtacggtaccttaccggaccgtaacccgttagttaccgttacggtttaccttacc

SEQ ID NO: 172049 - DNA, 590 bp, Homo sapiens
  misc_feature: GYAE6OF02I2TEB.27.78.H01.1.454.CMB.1.raw
  modified_base (229)..(229): a, c, t, g, unknown or other
  misc_feature (229)..(229): n is a, c, g, or t
  modified_base (452)..(452): a, c, t, g, unknown or other
  misc_feature (452)..(452): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggcagtcagagcgttggtagtagcttacactggtaccagcagagccaggtcagtctaccaaagcctcctcactcaagtatcgtccttacccacgttccttctccgacggggttcccctgtacggtttcacggtggcctaggtggactcgtacgggactactatttccaaccctcaccctataccaagtacgtcctagggaacncgtagaagtactgacttgacctaacttacttactgtcagtacagtaacgttacttaaccttacgtactaacggtcgtacttacctaacgttaccgacgtaacggactaacgtacgtacgggaactaagttaaaaccgg

SEQ ID NO: 172050 - DNA, 549 bp, Homo sapiens
  misc_feature: GYAE6OF02GGEQW.27.78.H01.1.454.CMB.1.raw
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaagccaggtcagtctaccaaagcctcctcatcaagtatgccttcccagtccttctcgacggggtcccctgacggttcagtggcaggtggactcgtgggacactatttccaccctcaccatcaatcgcctggaagctagaagntgctgactaactttattactgtacatcagtaacgttacttacctttactactaagtcattacctaccgttacggaccgaacgggacctaaccggacgtaggtagtaacttaaaccgg

SEQ ID NO: 172051 - DNA, 548 bp, Homo sapiens
  misc_feature: GYAE6OF02JEIAJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgtaggttcagtggcagtggatctgggacacattcacctcaccatcaactagcctaggaacgctagaagatgctgactaacttattactgtctatcagtagtacttactttactactaagtgatcaccgttcggacctaaacgggaccaccggactaggaacgtaaacgtttaaacgaacgttgtacggtcctacggtacctaccgtactcttcgtacctttaccg

SEQ ID NO: 172052 - DNA, 511 bp, Homo sapiens
  misc_feature: GYAE6OF02F1ISF.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggcagtcagagcgttggtagtagcttacactggtaccagcagaagccaggtcagtctccaaagctcctcatcaagtatgcttcccagtccttctcaggggtcccctcgaggttcagtggcagtggatctgggacacgatttccaccctcacccatcaatacgcctggaagctagaagatgctggacaacttattactgtcatcagtagtactactttactcaagtgatccacttcggaccaagggaccagtacaggagtaattaaacgagtgtaggctgacaccatctgtcttac

SEQ ID NO: 172053 - DNA, 541 bp, Homo sapiens
  misc_feature: GYAE6OF02IHZX6.27.78.H01.1.454.CMB.1.raw
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
  modified_base (403)..(403): a, c, t, g, unknown or other
  misc_feature (403)..(403): n is a, c, g, or t
  modified_base (454)..(454): a, c, t, g, unknown or other
  misc_feature (454)..(454): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggcagtcagagcgttggagtagcttanactggtaccagcagaagccaggtcagtctacaaagctcctcatcaagtatgtcttcccagtccttctcgacggggtcccctgtacggttcaggtcggcagtggatcgtgggactactatttccaccctcaccatacaaatcgacctaggaacgtctagaanatgactgactaattattactgtacatcagtatactaactttaccataagtnataccaccgttacggacgaacggacacgacgtaggacgtaacttaaacgacgtaggtcgatacgactaaccgatctacgtacttacg

SEQ ID NO: 172054 - DNA, 616 bp, Homo sapiens
  misc_feature: GYAE6OF02GQBYY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctaccaaagctcctcatacaagtatcgtccttcccgacgttcccttccgtccgtaccggggttccccctcggtacggttcgaggtcggtcgtaggtggtactcgtacgggacacctactttccaacccctcaccctactacaaatacgccgtaggaacgcctaagaagtactcgctagacctaatttacttactgttacactcgaagtactaactttacctttacctacgtaagttcgtaacttaccgtacccgttaccggacccgaacggggtacctaaccggtacgtacggtacgtaacgttaaaccgg

SEQ ID NO: 172055 - DNA, 577 bp, Homo sapiens
  misc_feature: GYAE6OF02FWNIW.27.78.H01.1.454.CMB.1.raw
  modified_base (396)..(396): a, c, t, g, unknown or other
  misc_feature (396)..(396): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcccttctacgacggggtcccctcgacggttccaggtgcagtggatcgtggacactatttccacctcaccataccaatacgcctaggaanctagaagatggctagactaacttattactgtacatcagacgttacttacctttaactccgtaagtcgaattcctacccgttacggacccaaaggggccctaacgacgtaggtaacgtaaacgttaaaaccggaacgttgtaccgggacttacgtaccgaaccctagttccctggtttaccc

SEQ ID NO: 172056 - DNA, 544 bp, Homo sapiens
  misc_feature: GYAE6OF02JEPRE.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacacgtgtaccagacagaacgaccgaggtcaggtctccaaagctacctcatcaagtactgacttcccagtcccttcgtcctaggggtcccctcggacggttcaggttcggcagtggatctgggacacgattcacccttcaccatccaatagacctggaacgctagaagatgctagctaactattactgtacatcagtagtactacttacctactaagtcgtaacttcaccttacggacctaagggaccacgactaggaacgtactaaacgaactagtagactagacacactactgtac

SEQ ID NO: 172057 - DNA, 606 bp, Homo sapiens
  misc_feature: GYAE6OF02G4ZPA.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaaagctcctcatcaaagtatgccttcccagtccttctcacggggtcccctcgaggttcagtggcagtggatcgtgggacacatttccaccctcaccatcaatacgcctaggaacgcgtagaaagatcgactgactaacttattaactgtacatcaagtaacgttacttaacctttaacctacgtaaacgttgtaacttacctaacccgtttccggaaccgaaagggaaccctacgaacgtacggaaacgtaaacgtttaaaaccgaacgttacggttacgggcccttacgggtaaccctaaccgtaacttccgtagtttaacccg

SEQ ID NO: 172058 - DNA, 545 bp, Homo sapiens
  misc_feature: GYAE6OF02HFURN.27.78.H01.1.454.CMB.1.raw
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacggggtcccctcggacggttcagtggcaggtggatcgtgggacactatttccaccctcaccatcaatacgcctggaacgctagaanatgctgactaacttatactgtacatcagtacgttacttacttacctactaagtcgaactctaccgttaccggaccaacgggaccacgtactacggtacgtaagttaaaccgg

SEQ ID NO: 172059 - DNA, 729 bp, Homo sapiens
  misc_feature: GYAE6OF02JM83D.27.78.H01.1.454.CMB.1.raw
  modified_base (159)..(159): a, c, t, g, unknown or other
  misc_feature (159)..(159): n is a, c, g, or t
  modified_base (182)..(182): a, c, t, g, unknown or other
  misc_feature (182)..(182): n is a, c, g, or t
  modified_base (257)..(257): a, c, t, g, unknown or other
  misc_feature (257)..(257): n is a, c, g, or t
  modified_base (344)..(344): a, c, t, g, unknown or other
  misc_feature (344)..(344): n is a, c, g, or t
tcagagcgtcgtctcacgaccggtgctcgatttagtgtgagtagtttgggtttggggggtcgatgagcaaaactagacaagtcaaggcaggaagatgttgccatcacaactcattgggtttctgctgctctgggttccagcctccaggggtgaaattgngctgactcagtctccagactttnagtctgtgactccaaaggagaaatcaccatcacctgccggccagtcagagcttggtatagcttacactggtaccngacagacgccaggtcaggtctaccaaacgctcctcactcaagtactcgtccttcccagttcccttctccgaaccggggttttccccnccggtaaggttccaaggttggacctaggtcggaatccggttacgggaactacctattttccgaaccccttaccaccaaatttcgaaaacgttcgtaccgttacggaacggtccttaaggtaacgaacgttcgtacgtacgtacccggttaaactttaacttaaccgttagttactaacgttacgtaacggtaacgttaaccgtttaaccgttttaaccctaaccgttaaacgttacggtaacttacccgttaacccggttaccgtaacccggtaacggaacccgttacgaaccggttcgggtaaagtaacgtttaaaccggaaacgttacggttaaccggtacgttacgggacctaaccgggtaacctttccgaccgtttaaccg

SEQ ID NO: 172060 - DNA, 517 bp, Homo sapiens
  misc_feature: GYAE6OF02ITIEA.27.78.H01.1.454.CMB.1.raw
  modified_base (343)..(343): a, c, t, g, unknown or other
  misc_feature (343)..(343): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgtcgggccagtcagagcgttggtagtagcttacactggtaccagcagaagccaggtcagtctccaaagctctcatcaagtatgcttccagtccttctcacgggtccctgagttcagtgcagtgatcgnggacactattcacccttcacctatcaatacgcctaggaacgctagaagatgctgactaacttattactgtcatcagagtactacttactnagtgactctacgtcgacgaaggacacgtacgaggaagtaacttaaacgtactaggtacggtctagacctacgacttctgttacc

SEQ ID NO: 172061 - DNA, 501 bp, Homo sapiens
  misc_feature: GYAE6OF02FWVVG.27.78.H01.1.454.CMB.1.raw
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtgcagtggatctgggacacatttcaccctcaccatcaatgcctggaagctagaagatgctgcaacttattactgtcatcagatactacttacnaagtnatcaccttcgaccaaggacacgactggagataaaccg

SEQ ID NO: 172062 - DNA, 734 bp, Homo sapiens
  misc_feature: GYAE6OF02I2J13.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtgactcaaaggagaaagtcaccatcaccgtgccgggccagtcagagcgttggatgcttacactggaccagcagaagccaggtcagtctccaaagctcctcatcaagtatgccttcccagtccttctccgacggggtcccctcggacggttcgaggttcggctaggtcggatcgtacggggactacgtactttccgacccttacaccgtatacaaagtacgaccgtaggaacgtcgtaagaaacggattcggactacggtaaccttaaaactttaactttaaccgtcgttacctaacgttaccgtaacgtaacgtttaaacccgtttaaccttttaaacccctaacgttaaacggttagtaaccttacccgtaacccgttttaaccgggaccccggtaaaacggggtaaccctaaccgggtaaccgttaacggggtaaacggttaaaccgtttaaaaaccgggtaaaccggttacgggttaacggtacccgttacgggtaacccgttaaacccgtaacgtttacccggttttacggttacccctttacccgg

SEQ ID NO: 172063 - DNA, 588 bp, Homo sapiens
  misc_feature: GYAE6OF02HNDUJ.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggcagtcagagcgttggtagtagcttacactggtaccagcagaagccaggtcagtctaccaaagcctcctcatcaagtatgccttcccagtccttctcgacggggtcccctcggagttcacggtgcagtggactcgtagggactactactttccaccctcaccatacaatacgccgtaggaacgtctagaacgagtgaccgtgacctaaactttacgttacttgtactatacgagtaacgttacttacctttaccacgtaaggttgtaacttcccgtaacccgttccggaacccgtaacggggtaccaaccgtaggtacggtaagtaacttaaaaccgg

SEQ ID NO: 172064 - DNA, 534 bp, Homo sapiens
  misc_feature: GYAE6OF02GAHRP.27.78.H01.1.454.CMB.1.raw
  modified_base (448)..(448): a, c, t, g, unknown or other
  misc_feature (448)..(448): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtgcagtggatctgggacacacttcaccctcacctatcaatacgcctaggaagctagaagatgctgactaacttattactgtcatcagtagttactactttacctactaagtnactcaccttcggaccgaagggacacgacgtacggaagtaactaaacggtaactggtaggtctacgacctacacgttctcgttaccc

SEQ ID NO: 172065 - DNA, 596 bp, Homo sapiens
  misc_feature: GYAE6OF02IA6QW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggccagtcagagcgttgttagtagcttacactggtaccagacagaagccaggtcagtctacaaagctcctcatcaagtatgccttcccagtccttctcgtacgggtcccctcggtacggttcagtcggcagtggatcgtcgggacctacgtaactttccgacccttacaccctactacctaatacgccgtaggaacgtcgtaagaagtatgctacggactaacttattacttcgtactacgtcaacgtacgttaccttactttacctactaagtagacttccgaaccgtttcggaccgaaagggaccaacgtacgtaggaagtaacgttaaaccgaagttcgtacggtcgtacgtacaccgtacgtcttacgttccttacc

SEQ ID NO: 172066 - DNA, 511 bp, Homo sapiens
  misc_feature: GYAE6OF02HM7AX.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttctcacggggtcccctcggacggttcaggtcggcaggtggatctgggacacatttccaccctcaccatcaatacgctggaagtcctagaagatgctgactaacttattactgtcatcagtatacttacttaccactagtnacttcaccgttcggccaaagggcacggactggaataataacgatgtagctgccacatctgtctc

SEQ ID NO: 172067 - DNA, 700 bp, Homo sapiens
  misc_feature: GYAE6OF02H96CD.27.78.H01.1.454.CMB.1.raw
  modified_base (321)..(321): a, c, t, g, unknown or other
  misc_feature (321)..(321): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagttctgtgactccaaaggagaaacgtcaccatcacctgccgggcagtcagagcgttggtagtagcttacactggtaccagcagaacgccaggtcagtctccaaagctcctnatcaagtctgccttaccagttcccttcgccgaggggtcccctggtacggttcagtggacaggttggactcgtagggaccacgtacgtttaccacccttacgaacctactacaaacttacggacccttagggaaacgtccgttaaggaaacgtacgtacggaccttaggtaaccctaaacgttttaccttaacgtttacgtaccgttaaagtcccgtaaagttaaccggtttaaacctttaaccctttttaacccttaccgttaaacggttcgtaacctttaccgttaacccccgttttacccgggaacccgtaaacggggtaacccgttaaaccggtaaccggttaacggggtaacgttaaacggtttaaaaacccggg

SEQ ID NO: 172068 - DNA, 519 bp, Homo sapiens
  misc_feature: GYAE6OF02G0HP5.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccacctccaccatcaatacgctaggaagctagaagatgctgactaacttattactgtcatcagtagtacttactttaccactagtacatcctaccttcggaccaaggaccacgactaggacgtaattaaacgactgtggtctgacaccgtatctgtacttac

SEQ ID NO: 172069 - DNA, 556 bp, Homo sapiens
  misc_feature: GYAE6OF02JBRQU.27.78.H01.1.454.CMB.1.raw
  modified_base (298)..(298): a, c, t, g, unknown or other
  misc_feature (298)..(298): n is a, c, g, or t
  modified_base (430)..(430): a, c, t, g, unknown or other
  misc_feature (430)..(430): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccaggtcagtctccaaagctcctcactacaagtntgccttcccagttccttctcacggggtcccctcggaggttccaggtggcagtggatcgtgggacactactttccaccctcaacccatccaatcgccgtaggaacgctaggaagtatcgactgactaactttnttactgtcatcaagtacgttacttactttacctagtaagtnactccgtaccttcggaacgacggacacgtatcggaagtaacgttaaacgacgtcgtggacttacgaccaccgtactccgtacttc

SEQ ID NO: 172070 - DNA, 603 bp, Homo sapiens
  misc_feature: GYAE6OF02JM143.27.78.H01.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaattgtgctgactcagtctccagactttcagtctgtgactccaaagganaaagtcaccatcacctgccggccagtcagagcgttggtagtagcttacactggtaccagcagaacgccaggtcagtctccaaagcctcctcatacaagtatcgccttacccacgtcccttctcgtacggggtcccctacggtacgttcagtggcaggtggatcgtgggacacgtactttaccacccctacaccctagtacctaatacgtaccctaggaacgtcctaaggtaacgatacgactacggtaactaacgtttagtacctgtactaacgtcgaagtacgttaaccttacgttacctacgtaagttcacttaccgtaaccgttccggaaccgtaacggacctaaccggtaacgtcggaagtacgtaaacgg

SEQ ID NO: 172071 - DNA, 549 bp, Homo sapiens
  misc_feature: GYAE6OF02JJ2T2.27.78.H01.1.454.CMB.1.raw
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacacgtggtaccagcagaagccaggtcagtctccaaagctcctcatcaagtatgccttcccagtccttctcacggggtcccctgacggttcagtcggcagtggatcgtcggacactatttccaccctacaccataccaatacgcctaggaacnctaggaagtntgctgactaacttatactgtcatcagtactacttacttacctanagtntactcctacgttcggacaagggacctacgacgtaggaacgtaacgttaacgacgtggtacggtactacggacctaccacgttctagttaccttacg

SEQ ID NO: 172072 - DNA, 545 bp, Homo sapiens
  misc_feature: GYAE6OF02GBHR3.27.78.H01.1.454.CMB.1.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttcccagtccttctcagggtcccctgagttcagtggcagtgatctgggacactatttcaccctcaccatcaatacgcctaggaanctacgaagatgctgactaaacttattactgtctatcaagtacttaactactttacctcgtaagtcgtaactcaccgtttcgaccgtaacgggacaccgtatcgggaacgtaacgttaaacgaactggtacggtctacgcctaaccagttcctaggttcttaccg

SEQ ID NO: 172073 - DNA, 593 bp, Homo sapiens
  misc_feature: GYAE6OF02JI5RQ.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcccttctccgacggggttccccctcggtacggttccaggtcggctaggtcggatcgtgggacactactttcaccctcaccatacaatcgcctaggaagctagaagatgctgacctaacttattactgtacatacagagttactacctttacctacgtaacgttacgtactacctacccgttacggaccgtaacgggaccacggtacgtgggtaacgtaacgttaaaacggtacgttaggtacggtacgttacggaccctaaccgtacgttccttacggtttaccc

SEQ ID NO: 172074 - DNA, 709 bp, Homo sapiens
  misc_feature: GYAE6OF02FXV11.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatccaagtatcgccttcccagttcccttctccgacggggttccccctcggtaggtttccaggtcggccgtaggtggtactccgtaggggacctacgtacttttacccgaccccttccaacctacttacctaaactacggacccttagggaaacgtcctaggtaaacgacttacggtaccgtagtaacccttaaaacttttacgtttaaaccgttcggttaacctaacgttcctaaaggttaaccgtttaaccgtttaacccttttacccgttaactaaacgggttctaaccgtttaccctaaccccgtttaaccgggtaccccgtaaacggggtaaccctaaccgggtaaccggtacgggtaaacggtaaccgtttaaaaaacccggg

SEQ ID NO: 172075 - DNA, 727 bp, Homo sapiens
  misc_feature: GYAE6OF02IWXJQ.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaaccatcacctgccgggccagtcagagcgttggtagtagcttacactcggtaccagcagaagccaggtcagtctaccaaagctcctacatacaagtatgtccttccccagttccttcctcgtaccggggtcccctcggtacggttcgagtcgggcacggtggagttccgtaggggactaacgtacttttaccacccctcaacccaacttcaaatacgcccttagggaactaccgtaggaaacgtattcggaccttagacctaaaccgttttactttaacctcggttacctaattaccgtaaaggtaacgtttaaacccttaaccgtttttaaccccgttaactaaacggttacgtaaaccttacccgtaaccccgttttacgggaaccccgtaaaacgggggacctaaacccggtacgggttaacggtaaccggtaaaacgtttaaaacccggaaaccggtttaggacgggttaccttacggaccctaaaccgttacttcccgttttacgttcccgtttaaccc

SEQ ID NO: 172076 - DNA, 638 bp, Homo sapiens
  misc_feature: GYAE6OF02JXO4O.27.78.H01.1.454.CMB.1.raw
  modified_base (246)..(246): a, c, t, g, unknown or other
  misc_feature (246)..(246): n is a, c, g, or t
  modified_base (621)..(621): a, c, t, g, unknown or other
  misc_feature (621)..(621): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttanactggtaaccagcagaagccaggtcagtctccgaaagctcctacatccgaaagtactgtaccttcccgaagttccttcctcgtacgggggtacccccttgacggtttcaggtcggcaggtggactcgtgggaactaacgtctttacgaccccttcgaacctatacctaaatacgtccgtaggaaacgtctagtaaacgatcggactagaaccttaaacgttacttaattcggtacttacgtacgtaagtacgttaaccttactttaacctacaaacgtttgaacctccgtaccgtttacggaacccgtaacgggaacacccggttacaggaacgtaacttaaaacgcgttaacggcgtacgtagccctaaaccgnttacgttgtaccttacg

SEQ ID NO: 172077 - DNA, 513 bp, Homo sapiens
  misc_feature: GYAE6OF02HDEE0.27.78.H01.1.454.CMB.1.raw
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcggtagttcaggtggcaggtggatcgtgggacactatttccaccctcaccatacaaatacgcctggaagctagaagatggctgacaactttattactgtcatacagtagtacttactttaccntaagtgatccacttcgacgaaggacngactgaagaacttaaacgactgtgntcgacacatntntc

SEQ ID NO: 172078 - DNA, 733 bp, Homo sapiens
  misc_feature: GYAE6OF02FS6BO.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaagtagaagtacgaccactactacctaccgtccgggcccggacgtacgtacggaggacggttcggttaggtaaggtacgttacctactacggtaccgtaacgacgacgaacggaaccgacggtacgtacgtaccgtaccctaaacgaccgtccctacctactacgtaacgtaagtcgtccgttccctaccgttccgtttcccttcgtaccggggttccccgttcccgtacggttacgtacgtacggtcgacgtgggtacgtcggtcgggtacggaactacgtttaccttacccctacccgtacctaacctacctaaactaacgtcccgtacgggtaagaccgtagtaagggaacttgccgtagtaacctaaaccttttaaattcgtacgttcgaactctaaacggtaagttacctttaaaccgtttacctaccgaaagtatcctaccttaaccgtccgggtaacaacggggaaccctagacctagggattaaaccgtaaacgtaagtcggtgaccgtcaccgaactactcgtttacgtacg

SEQ ID NO: 172079 - DNA, 530 bp, Homo sapiens
  misc_feature: GYAE6OF02G1WI0.27.78.H01.1.454.CMB.1.raw
  modified_base (228)..(228): a, c, t, g, unknown or other
  misc_feature (228)..(228): n is a, c, g, or t
  modified_base (483)..(483): a, c, t, g, unknown or other
  misc_feature (483)..(483): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgccttcccagtccttctcacggggtcccctcgaggttcagtggcagtggatctgggacacatttccaccctcaccatacaactacgccaggaagctagaagatgcgtgctaacttattactgtcatcaagtagttacttaccttactactaagtnatcctaccgttcgaccgaacgggacacgacgtggacagttaaaccgg

SEQ ID NO: 172080 - DNA, 703 bp, Homo sapiens
  misc_feature: GYAE6OF02JFLCD.27.78.H01.1.454.CMB.1.raw
  modified_base (236)..(236): a, c, t, g, unknown or other
  misc_feature (236)..(236): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
tcagagcgtcgtctcacgaccggtgctcgatttagtgtgagtagtttgggtttggggatcttaaaagaggttctttctctgggatgtggcatgagacaaaactagacaagtacaaggcaggaagatgtgcatcacaactcattggtttctgctgctcgtcggttccgacgcctccgagggtagtaagttgtgtctgactactacgtctacctacgtacttactacgtcgtgtacgnacgtaccgaaaggaacgaaacgtacaccactacgtaccgcnggaccggaccgacgtacgaggagtacnggttacggtaagtacgtacgttaacgtaacgtacggtaaccgaacgacgaagaacgaccgtacggtacgtaacgtacctaaccgtaaacgacctaccgtactaactacgtaacgtaacgtacgtaccttaccgtacgtaccgttaccgtacgtacgggtacccgtacggtacggtacgtacgtacggacgtacgtaggtacgtacgtacggtacgtactacttacctacctaccaacctactactaacgtacgtacgtacgaacgtacgtaagaagtagtacgtacgtacgtacgtaacttactactacgtactactactacgtacgtaacttaacttacctaacgtaacgtacgtacgtaccgtaaccgttaccggtaaccgtaacggtaacgtaacg

SEQ ID NO: 172081 - DNA, 688 bp, Homo sapiens
  misc_feature: GYAE6OF02JXRN4.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctccgaggggtnaaattgtgctgactcagtctcagtactttcagtctgtgactcaaaggagaaagtcaccatcaccgtgccggccagtcagagtcggttggtagtacgacttacacgtggtaccagacaaggaacgccgaaggtccagtcctaccaagtcctcctacataccgaagttatcgtccttacccgtacgttcccttaccgtccggtaccggggttcccctggtacggttcacgggtcggtcgaggtcgacgttcggtacgggaacctactacgtttcccgaacccctaccgtaactacgtaccgtaacgtacgtaccgtaggaccgtaccgtaggaacgtacgtgaccgttacgaacctttaacgttactttaccgtagttacctaacgtacgtaaacggttaaccgttacctttaaccgttaccgtacgtaaccggttaacgtacttaacccgtaccgtaccggtaacgtaaccgggtacaccggtaacgtacggtaacgtaacgttaaacgg

SEQ ID NO: 172082 - DNA, 567 bp, Homo sapiens
  misc_feature: GYAE6OF02IYIHW.27.78.H01.1.454.CMB.1.raw
  modified_base (337)..(337): a, c, t, g, unknown or other
  misc_feature (337)..(337): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (513)..(513): a, c, t, g, unknown or other
  misc_feature (513)..(513): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccacctgccgggccagtcagagcgttggtagtagcttacactggtaccagcagaagccaggtcagtcctaccaaagcctcctcatacaagtatnccttcccagttcccttctcgacggggtcccctcggacggttcagtggcagtggatcgnggaccatacgttccaccctcaccatacaagtcnccgtaggaacncgtagaagtntgctagaccttaacttacttacgtgtacattacaagtacttacttaacctttactactaagttnactacctaccgttcggaccgaacggacaccgtacgtagtacgtaattaaaccgg

SEQ ID NO: 172083 - DNA, 586 bp, Homo sapiens
  misc_feature: GYAE6OF02H0NN9.27.78.H01.1.454.CMB.1.raw
  modified_base (396)..(396): a, c, t, g, unknown or other
  misc_feature (396)..(396): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctgaggttcaggtggctagtggatcgtgggacacgtatttccaccctccaccactcaatacgcctaggaacnctaggaagatgctgctaactttattactgtcatcaagtagtaaccttactttaacctacgtaagtcgtaatcctaccgtttccgggaccaaagggtaccaaccggtacgtagggtaacgtaaacgttaaaccggaacgttcggttacggccgtaggaccctacccgtattccgtttagttcctttacccg

SEQ ID NO: 172084 - DNA, 524 bp, Homo sapiens
  misc_feature: GYAE6OF02GR4OJ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatacaatacgcctggaagctgaagatgctgctaacttattactgtcatcagtagtacttactttacctacaagtcgattcacctttcggaccaagggacaccgagtaggacgtaataaaccgaactagtaggtctacgccaccgatctacgttcttac

SEQ ID NO: 172085 - DNA, 572 bp, Homo sapiens
  misc_feature: GYAE6OF02JFQTO.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactcaaaggagaaagtcaccatcacctgccggccagtcagagcgttggtagtagcttacactggtaccagcagaagccaggtcagtctaccaaagcctcctctatcaagtactgccttcccagtcccttctcgacgggtcccctcgaggttcagtcggcagtggtatcgtgggacactacttcaaccctcaccatacaatacgaccttgggaactctagaagatgctcgactaacttatactgtacagtcagtacgtacttaacctttaccacgtaagttctactaccgtaacccgtttccggaacccgtaaacgggtacccgaaccgtacggtacggataagttaaaaccgg

SEQ ID NO: 172086 - DNA, 721 bp, Homo sapiens
  misc_feature: GYAE6OF02IUSHX.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaagganaaagtcaccatcacctgccgggcagtcagagcgttggtagtagcttacacgtggtaccagcaagaagccaggtcagtctaccaagctcctcatcaagtatcgccttcccagttcccttctccgaccggggttcccctggtacggttcgaggtcggcaggtgacgtcgtgggactactatttccaccctacgaacctatacgtaaagttaccgaccgtaggaacgtacgtaaggtaaacgtactacggtaccgtacgtaacccttaaacttttaacgttaacgttacgttacctaacgttaccgtaaaggttaacccgtttaaaccgtttaacccttttaacccgtacgttaaacgttaccgtaaccgttacccgttaacccgttacccggtaaacccggtaaacggggaacccttaacccgggtaacggtttagggaaaccggttaaacgtttaaacccgggacgttaacgggttcggaacgttaccgaccgtaacctagtttaccgttacgtcccgttaaccg

SEQ ID NO: 172087 - DNA, 583 bp, Homo sapiens
  misc_feature: GYAE6OF02HM902.27.78.H01.1.454.CMB.1.raw
  modified_base (195)..(195): a, c, t, g, unknown or other
  misc_feature (195)..(195): n is a, c, g, or t
  modified_base (480)..(480): a, c, t, g, unknown or other
  misc_feature (480)..(480): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccaggtcagagcgttggtagtagcttacactggtaccagcagaagccaggtcagtctccaaagctcctcatcaagtatcgccttcccgagttcccttcgtcgtacgggggtccccctcggtacggttcaggtggcagtggatcgtagggacactatttccaccctcaaccctataccaaatacgccgtagggaacgtccgtagaagattgctgactaacttattactgtacatcgagacgttactactttacctactaagtnactctaccgttacggaccgaaggaccacgactgggaacgtaagttaaaccgacttggtacggtctacggtaccaaccgttacttacgttcgttacctttaccg

SEQ ID NO: 172088 - DNA, 522 bp, Homo sapiens
  misc_feature: GYAE6OF02FXQ86.27.78.H01.1.454.CMB.1.raw
  modified_base (230)..(230): a, c, t, g, unknown or other
  misc_feature (230)..(230): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagttcccttctcacggggtcccctcgacggttcaggtggcaggtggatcgtgggacactatttccaccctcaccatcaatacgcctggaagctagaagatgctgactaacttatactgtcatcagtagtactactttaccanagtnatcaccttcggaccaaggcaacgactggagtattaaaccg

SEQ ID NO: 172089 - DNA, 855 bp, Homo sapiens
  misc_feature: GYAE6OF02FFD6I.27.78.H01.1.454.CMB.1.raw
  modified_base (160)..(160): a, c, t, g, unknown or other
  misc_feature (160)..(160): n is a, c, g, or t
  modified_base (169)..(169): a, c, t, g, unknown or other
  misc_feature (169)..(169): n is a, c, g, or t
tcagagcgtcgtctcacgaccggtgctcgatttagtgtgagtagtttgggtttgggggcatgagacaaaactgacaagtcaaggcaggaagatgttgccatcacaactcgtagttggtttctgctgcgttcgtgggttacccagtccgtacgagggttanaagtttcgngctagacctacgacgtcctactagttacttacgagtctagtacgaactacgaaggtaacgaacgtaccaccgtacgtaccgaccggtccggaccggacctagtacgaggtacgtcggttaggtacgtacgtaccttacgacgtacgaaccgagacgacgaccgtcgacgttaccgacttaccgaacctaacgtcctactacgtaactacgttacgtaccgttcccgttaccctcccgttacggtttaccccgtttaccgtacccgggtttacccggttacccgtacggttacggttacgacgggttacggacgttacggtaccggtaccgttaccggtaaaccgtacccttaacccgttacctaacccgaaccttacgaacgtagtttaaccgaacggttcgaacggttacgtaacgtagaacgttaacgttaccgtacgtaaccgtttaactacgtttaacgttactaccgtaacgtttaccgaaaccgtttacgttaacccgtttacctttaaaccggttaccgtaacgttaaccggttacgtaacccggtaacccggttttaaccggaaaccgtaacgggaaccgttaaccggaacgtttacggaacgtaacggttaaacgacggttacctacggttccgaacgtccaaccgttaccgttactcgtttacccttcgtaacccg

SEQ ID NO: 172090 - DNA, 532 bp, Homo sapiens
  misc_feature: GYAE6OF02IU03U.27.78.H01.1.454.CMB.1.raw
  modified_base (441)..(441): a, c, t, g, unknown or other
  misc_feature (441)..(441): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggcagtcagagcgttggatagcttacactggtaccagcagaagccaggtcagtctccaaagctcctcatcaagtatgcttcccagtccttctcacggggtcccctgaggttcagtggcagtggatctgggacacgtatttccaccctcaccatcaatagcctaggaagctagaacgtatcgctgaccaacttattactgtctatctagacttactacttacctnaacgtgactctaccgttcggaccgaagggaccacgacgtaggagtaacttaaacgaacttggtacggctcgaccgactactcgtgttaccg

SEQ ID NO: 172091 - DNA, 556 bp, Homo sapiens
  misc_feature: GYAE6OF02HGP6L.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccggcagtcagagcgttggtagtagcttaacactggtaccagccagaagccaggtcagtctacaaagcctcctcatcaagtatgccttcccagtcccttctcgacggggttcccctcggtacgttcagtcgcgtagtggatcgtagggacactactttccaccctcaccatcaatacgctagagcagaagatgctgactaacttattactgtacactcaagtacgttaaccttacttacctacgtaagtcgaacttccgtaaccttcggaccgaacgggctaccggtaacgtaggagtaacgtaaaccgg

SEQ ID NO: 172092 - DNA, 585 bp, Homo sapiens
  misc_feature: GYAE6OF02GRQRS.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgtaggttcaggtggcgagtggatcgtgggacactatttccaccctcaccatccaactacgcccgtaggaacgcgtaggaagtatgctgacctaacttattactgtactatcgtagtacgttaccttactttacctactagttacgacttcctaacccttcggaaccgaacgggtaccacggtacgtggaagtaacgttaaaccggtacgttagtacggtacgtacggtacctacccgtacttccgtcgttacccg

SEQ ID NO: 172093 - DNA, 680 bp, Homo sapiens
  misc_feature: GYAE6OF02J0O2G.27.78.H01.1.454.CMB.1.raw
  modified_base (347)..(347): a, c, t, g, unknown or other
  misc_feature (347)..(347): n is a, c, g, or t
  modified_base (621)..(621): a, c, t, g, unknown or other
  misc_feature (621)..(621): n is a, c, g, or t
  modified_base (636)..(636): a, c, t, g, unknown or other
  misc_feature (636)..(636): n is a, c, g, or t
tcagagcgtcgtctcacgaccggtgctcgatttagtgtgagtagtttgggtttggggtagtcttaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccggccagtcagacggcgtttagggtagtacgcgtttacactgggtaacccagcaaggaacggccgaaggtcgaagtcctacccaaaaggtcctccctnaactaccgtaaagttagtcgtacctttcccgagtttcccttccgttacgaccgggggttccccctggtaacggtttcgaggttcggacgaacgggttcggacgtttcccgtggggaacctactaccgttttaccaaccccgttccaaccctaacgttaccgaaacgttccgaccgttacgggaaacgtccgttaagaaccgtagtacgtcgtcgtaactaaacctttagtttacctacgtctaacttacgataacggtttacttaccttacctntaacggtcaacgttntacccgttaccgacgtaacgacggacgctacggagtactaaacg

SEQ ID NO: 172094 - DNA, 502 bp, Homo sapiens
  misc_feature: GYAE6OF02G3WS6.27.78.H01.1.454.CMB.1.raw
  modified_base (388)..(388): a, c, t, g, unknown or other
  misc_feature (388)..(388): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacatttcaccctcaccatcaatacgcctaggaacnctagaagatgctgctaacttattactgtcatcagacgtacttactttacctctaagtgatcaccttcgaccaaggacacgctgganataacgactgngntcgcacatctgtctc

SEQ ID NO: 172095 - DNA, 642 bp, Homo sapiens
  misc_feature: GYAE6OF02JYXKY.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggagtgagcaaaactagacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggatagcttacactggtaccagcagaagccaggtcagtctaccaaagctcctcatcaagtatcgcttccagtccttctcacggggtcccctcgaggttcagtcggcagtggagtctggggacacgtactttcacccttcgaccactacaactacgccctaggtaacgctaggaaagactagcgtacgtaccgtaacttattaacgttgtacctaactccgaagtaacgttaccttaaccttttacctactaaacgttcgtaacttaccgttaacccgttacggtacccgaaaggggttacctaaccgggacttagggtaaacggtaacgtttaaaaacccggacgttaaccggttacgggtacttacggtaacccaccgtactttaaccgtccgtttacgttaacccgg

SEQ ID NO: 172096 - DNA, 585 bp, Homo sapiens
  misc_feature: GYAE6OF02GIKTN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtgcagtggatctgggacacatttccaccctcaccatcaatagcctggaagctagaagatgctagacctaaactttattacttgtactatcaagtacgtacttactttacctactaagtgaactcctaacccgtttccggacccgaaaggggacctacggaccgttagggaacgtaacgtttaaaaccggaacttacggtacgggtaccttacggaccctaacccgtacttcccttacggttaccctttaccg

SEQ ID NO: 172097 - DNA, 563 bp, Homo sapiens
  misc_feature: GYAE6OF02GVRUY.27.78.H01.1.454.CMB.1.raw
  modified_base (148)..(148): a, c, t, g, unknown or other
  misc_feature (148)..(148): n is a, c, g, or t
  modified_base (354)..(354): a, c, t, g, unknown or other
  misc_feature (354)..(354): n is a, c, g, or t
tcagagcgtcgtctcacgaccggtgctcgatttagtgtgagtagtttgggtttggggggcatgagcaaaactgacaagtcaaggcaggaagatgttgccatcacaactcattggtttctgctgctctgggttccagcctccaggggtnaaattgtgctgactcagtctccagactttcagtctgtgactccaaaggagaaagtcacatcacctgccggcagtcagagcgttggtagtagcttacactggtaccagcagaagccaggtcagtctacaaagctcctcatcaagtatcgcttccagttcctctcgacgggtccctgagtcagtggcagtgatcgtagggactacgtntttaccacccttcaacctataccaaatcgccgtaggaacgcttaggaagtagtcgtctagactaaacttattactgtacatcagtacgttaacttacttacctcaagtcgtactacctaccgttacggaccgaacggacacgtacgtaggaacgtaacgttaaacgacgttaggtacgtacgtacgtaccactacttaccgtgttaccg

SEQ ID NO: 172098 - DNA, 519 bp, Homo sapiens
  misc_feature: GYAE6OF02HBVU6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtggcagtggatcgtgggacacatttcaccctcaccatcaatagcctaggaagctagaagatgctgcaacttatactgtcatcagatactactttacctactaagtgactcaccttcggaccaaaggaccacgtacgtggagtaagttaaaccgaactgtaggactcgacacctagtcttgtcttac

SEQ ID NO: 172099 - DNA, 603 bp, Homo sapiens
  misc_feature: GYAE6OF02JHG6V.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctctcatcaagtatgcttcccagtccttctcacggggtcccctgacggttcagtgcagtggatcgtgggacacactttccaccctcaaccatccaaatacgccctaggaacgtctacggaaagattgcgtagactaaacttattaacctgtactactacagtacgttaaccttacttttacctacgtaagtcgaattacccgtaacccgtttccggaccgtaaacggggactaaccggtacgtacggaagtaaacgtttaaaaccggaacgttcgggtacggtcttacggcctaacccgtattcccgttagttacctttacc

SEQ ID NO: 172100 - DNA, 560 bp, Homo sapiens
  misc_feature: GYAE6OF02FYUGB.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcggacggttcagtggcaggtggatcgtgggacacgtactttcaccctcacctatccaatacgcctaggaacgctagaacgatgctgactaacttattactgtcatcagtacgtactactttacctactaagtgacttcaccttccggaccgaagggtccacggacgtaggtacgtaaacttaaaccggaacgttaggtcggtacctggaccctaaccgtattaccgtgttccc

SEQ ID NO: 172101 - DNA, 673 bp, Homo sapiens
  misc_feature: GYAE6OF02I8Q4F.27.78.H01.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (261)..(261): a, c, t, g, unknown or other
  misc_feature (261)..(261): n is a, c, g, or t
tcagagcgtcgtctcacgaccggtgctcgatttagtgtgagtagtttgggtttggggatcttaaagaggttctttctctgggatgtggcatgagcaaaactaacaagtcaaggcaggaagatgttgccatcacaactcattgggtttctgctgctctgggttccagcctcaggggtnaaattgngctgactcagtctccagactttcagtctgtcgactaccaaaggtcaaacgtccaccatcacctggccggcagtcagngtcgtaggtagtagcttacacgtgtaccagacagaagccaaggtcagtctaccaaagtcctacctcagtacaagtctacgaccttacctagtcccttcgtccgtacggggtccccctggtaacggttcacgggtggtacctaaggtcggtaactcggtacgggaacctaacgtacctttacccgaaccccttacaaccctacgttaccaaacgtacgtacccgtaaggaacgtcgttacggaaacgtagtacgacttacggaacctaaccgtttaacgtttacctaagtacgtactacgtaagtaacgttaacttaccgtttaacctacgttaacgtcgtaacgttacctaccggttaccggaaccgtaacggtaccgtacgtacgtacggtaacgtaacgtaacgtaacgg

SEQ ID NO: 172102 - DNA, 544 bp, Homo sapiens
  misc_feature: GYAE6OF02FLIOM.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtcccttctcgacggggttcccctcggacggtttcagtggctagtggatcgtgggacactatttccaccctcaccatacaatacgcctggaagctagaagatgctagctaactttattactgtacatcagtagtacttacctttactactaagtgtactactaccgttcggaccgaacgggtacacggacgtaggacgtaattaaaccg

SEQ ID NO: 172103 - DNA, 530 bp, Homo sapiens
  misc_feature: GYAE6OF02GQJZ1.27.78.H01.1.454.CMB.1.raw
  modified_base (378)..(378): a, c, t, g, unknown or other
  misc_feature (378)..(378): n is a, c, g, or t
  modified_base (418)..(418): a, c, t, g, unknown or other
  misc_feature (418)..(418): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcacggggtccctcgaggttcagtgcagtggatcgngggacactatttccaccctcaccatcaatacgcctggaanctagaagatgctgactaacttatactgtcatcagtagtacctactttacctacgtagtctactcgtaccttcggacctaacgggacaccgacgtaggacgtaagttaaacgg

SEQ ID NO: 172104 - DNA, 512 bp, Homo sapiens
  misc_feature: GYAE6OF02HL8J8.27.78.H01.1.454.CMB.1.raw
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtgcagtggatctgggacacatttcaccctcaccatcaatagcctggaacgctagaagatgctgactaacttattactgtcatcagagtactactttacctctaagtnactcaccttcggaccaagggacacgactgganattaaacg

SEQ ID NO: 172105 - DNA, 693 bp, Homo sapiens
  misc_feature: GYAE6OF02JGJJ3.27.78.H01.1.454.CMB.1.raw
  modified_base (198)..(198): a, c, t, g, unknown or other
  misc_feature (198)..(198): n is a, c, g, or t
  modified_base (457)..(457): a, c, t, g, unknown or other
  misc_feature (457)..(457): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtatagcttacactggtacccagcagaagccaggtcagtctccaaagcctcctcactacaagtatcgccttcccacgttcccttctccgacggggttcccccttcgacggttcacggttcggctaggtacggattccgtgggtaaccaccgaacttttccaaccccgttccaaccctactaccgtaaactaaggcccttagggaacgtaccttggaaacgtntacgccgttagacctaacgttatttaccgtgttacactacgacgtaacgttaccttaacctttaccgttaactaaacggttcgtaactaccgttaaccgtttacccgggacccgtaaacgggacctacccgggtacttacgggtaagtaacggtttaaaaacccgacttacgggtacggtactttaccgggacctaacccggtaacttacccggtttacggttccctttaacccgg

SEQ ID NO: 172106 - DNA, 642 bp, Homo sapiens
  misc_feature: GYAE6OF02I86OE.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttaacacgtggtaccagcagaagccaggtcagtctcaaagctcctcatcaagtactgtccttcccacgttccctttccgtccgtaccgggggttccccctacggtacggtttccgaggttcggccgaggtcgggtacgtcgtacggggacctactacgttttcccacccctactaaccctaattaccaaacgttacgcccgtaggaaacgcttaacggaagtactggcttacgacttaaacttatttacgtacgtcaattccaagtacttaaccgttactttaacctactaagtcgtaactccgtaccttcggacccgtaaagggacctacgactacggaacgtaacttaaacgtacgtcggtacggactacgcgtaaccgtacttcgttacgtcttaccg

SEQ ID NO: 172107 - DNA, 560 bp, Homo sapiens
  misc_feature: GYAE6OF02G2RKF.27.78.H01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaagganaaagtcaccatcacctgccgggccagtcagagcgttggtagtagcttacactggtaccagcagaagccaggtcagtctaccaaagctcctcatcaagtatgcttcccagttccttctcacggggtcccctcgaggttcagtggcagtggatcgtgggacacgtatttccacccctcacccatcaatacgcctaggaacgtctagaagatgctgactaacttatactgtcatcagacgttactactttacctctaagtgtacttaccgtacccgtttccggaacccgtaacgggaccaaccgtacgtacgggtagtaacttaaaacccgg

SEQ ID NO: 172108 - DNA, 558 bp, Homo sapiens
  misc_feature: GYAE6OF02I79OJ.27.78.H01.1.454.CMB.1.raw
  modified_base (510)..(510): a, c, t, g, unknown or other
  misc_feature (510)..(510): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcgccgggccagtcagagcgttggtagtagcttacactggtaccagcagaagccaggtcagtctaccaaagcctcctcactcaagtatgtaccttcccacgttcccttctcgaccggggttcccctcggaggtttcaggtcggactaggtggactcgtgggaccactactttccaccctcaaccatacaatacgtccgtaggaacgctagaagatcgctgactaacttattactgtacatcagtattaccttacttaccataagtntactcaccgttacggacctaacggacacgagtacggagtaattaacgg

SEQ ID NO: 172109 - DNA, 498 bp, Homo sapiens
  misc_feature: GYAE6OF02G4VOQ.27.78.H01.1.454.CMB.1.raw
  modified_base (385)..(385): a, c, t, g, unknown or other
  misc_feature (385)..(385): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagtagtactactttacctnaagtgatcaccttcggccaagggacacgactggagattaaacgactgtgctgccaccatctgtc

SEQ ID NO: 172110 - DNA, 511 bp, Homo sapiens
  misc_feature: GYAE6OF02HYCU1.27.78.H01.1.454.CMB.1.raw
  modified_base (312)..(312): a, c, t, g, unknown or other
  misc_feature (312)..(312): n is a, c, g, or t
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtcctctcngggtcccctcgaggttcagtggcagtggatctgggacacgatttcaccctcaccatacaatacgcctaggaagctagaagatgctgcaacttattactgtcatcagtagtaccttaactttacctactaagtnatctaccttcggccaagggacacgactggaagattaaacgactagtggctagcaccatctgtcttc

SEQ ID NO: 172111 - DNA, 578 bp, Homo sapiens
  misc_feature: GYAE6OF02FS460.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaacgccgaggtcagtcctaccaaagcctcctacatacaagtatgccttcccattcccttctcgtaccggggtccctgacggttcacgtgctagtggactcgtgggacctactactttccaccctacacctaatacaatacgccgtaggaacgcgtacggaagagtacgtctacgtacgtaacttattactgtacatacagtacgtacttaccttacctacgtacgtagacttacgtacccgttacggaccgtaacggaccaccgacgtaggtagtaacgttaaacgg

SEQ ID NO: 172112 - DNA, 538 bp, Homo sapiens
  misc_feature: GYAE6OF02HT13L.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgacggggtcccctcggaggttcagtggcaggtggatcgtgggacactatttccaccctcaccatacaatacgcctaggaacgctagaagatgctgactaacttattactgtctatcagtagttacttactttacctctaagtgtactcctaccttcggaccgaaggacacgtacgtacggagtagttaaacg

SEQ ID NO: 172113 - DNA, 498 bp, Homo sapiens
  misc_feature: GYAE6OF02IGI69.27.78.H01.1.454.CMB.1.raw
  modified_base (387)..(387): a, c, t, g, unknown or other
  misc_feature (387)..(387): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcacgggtcccctgaggttcagtggcagtggatcgtgggacactatttccaccctcaccatcaatacgcctaggaacnctagaagatgctgactaacttattactgtcatcagtatactactttacctanatgatcaccttcgcaaggcagactggagtataacgactgtgctgcaccatctgtctacg

SEQ ID NO: 172114 - DNA, 606 bp, Homo sapiens
  misc_feature: GYAE6OF02GVACQ.27.78.H01.1.454.CMB.1.raw
  modified_base (397)..(397): a, c, t, g, unknown or other
  misc_feature (397)..(397): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagctcctcatacaagtatgccttcccagtccttctcgacggggtcccctggtaggttcaggtggcaggtgatcgtaggacatactttcaccctcaccatacaatacgccgtaggaancgtagaaagatgactagtactaaacgttattactgtacattacgagtaacgttaccttaactttacctacgtaacgttanacttacgtaccgtccggaaccgtaaacgggaacctaacggtactagggtaacgtaacgttaaaaccgacgttcgttacgggtaccttacggaacctaacccgtaagttcccgttacgttaccgtttacc

SEQ ID NO: 172115 - DNA, 513 bp, Homo sapiens
  misc_feature: GYAE6OF02HMN7U.27.78.H01.1.454.CMB.1.raw
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcaggtggatcgtgggacactatttcaccctcaccatcaatagctagganctagaagntgctgactaacttattactgtacatcagtagtacttactttacctacaagtnattccaccgttcgaccaaggcagactaggaataattaaacgatcgtgctcggacacatctcgtac

SEQ ID NO: 172116 - DNA, 578 bp, Homo sapiens
  misc_feature: GYAE6OF02JEDYL.27.78.H01.1.454.CMB.1.raw
  modified_base (328)..(328): a, c, t, g, unknown or other
  misc_feature (328)..(328): n is a, c, g, or t
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacgggtcccctgnggttcagtcggcagtgatcgtggacacatttcaccctcaccatcaatacgcctaggaacnctagaagatgctgactaacttattactgtactatcaagtactacttaactttacctactaagtcgaacttcctacccgtttcggaccgaaaggggacctacgtacgtacgggaacgttaacgttaaaaccgaacgttacggtacggtacgttacggacctacccgtaattccgttacgttcctttacccg

SEQ ID NO: 172117 - DNA, 557 bp, Homo sapiens
  misc_feature: GYAE6OF02GD74X.27.78.H01.1.454.CMB.1.raw
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgccttcccagtccttctcgacggggttcccctcggacggttcagtggcaggtggatcgtgggaccactatttccaccctcaccatacaactacgcctaggaacgcgtagaagatgctgactaacttattactgtacatcgagtacttacttacttactntaagtnactcnccgttcggaccgaacggacacgacgtaggtaagtaacttaaaccggagttacggtacgtcgtcgtaccacgtagttccgtcttacc

SEQ ID NO: 172118 - DNA, 512 bp, Homo sapiens
  misc_feature: GYAE6OF02GEJF4.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtgatctgggacacatttcaccctcaccatcaatagcctggaagctgaagatgctgacaacttattactgtacatcagtagtactactttacctcaagtgatcacctttcggaccaagggacacgacgtaggagtaagttaaacgaactgtacggctcgcaccatctgtcttac

SEQ ID NO: 172119 - DNA, 536 bp, Homo sapiens
  misc_feature: GYAE6OF02GN25Z.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgccttcccagtccttctcgacggggtcccctggaggttcaggtggcagtggatcgtggggacactatttccaccctcaccatacaatacgcctaggaacgtctagaaagtatgctagtacctaacttacttactntcatcagtatactactttaccanagtgactcaccgttcggaccaagggaccagtacgtggacgaattaaacgacgtagtacgctacgacaccgtatcgtgtctacg

SEQ ID NO: 172120 - DNA, 627 bp, Homo sapiens
  misc_feature: GYAE6OF02H3VCX.27.78.H01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactaattgggtttctgctgctctgggttccagcctccaggggtnaaattgtgctgactcagtctccagactttcagtctgtgactccaaagganaaagtcaccatcacctgccgggccagtcagagcgttggtagtagcttacactggtaccagcaagagccaggtcagtctaccaaagctcctcactacaagtatcgtcttcccagtcccttctcgacggggtcccctacggtacgttcagtggctagtggactcgtaggacacgtactttccaccctcacctatcaatcgactaggaacgtctagaactagtcgactgtactaaactttacttacgtgtacacgttacacgtaacgttaaccttaccgtttaacccttacgtaaagttcggtaacttacccgtaaccggtttacccgggaacccgtaaacgggtacccgtaaccggtaacccggttagggaaaccgttaaccggttaaaaccgtaaccgg

SEQ ID NO: 172121 - DNA, 692 bp, Homo sapiens
  misc_feature: GYAE6OF02HP3CQ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtcctccagactttcagtctgtgactccaaaggagaaagtcaccatcacctgccgggccagtcagagcgttggtagtagcttacactggtaccagcagaagccaggtcagtctccaaagcctcctcatcaagtatgcttcccagtcccttctccgacggggttccccctggtacggttcgtagtggcaggtggacgtcgtaggggacactactttcccacccctaccaccctaactactaacgtacgtacccgtagggaaacggtacctaggtaaagagttacggaccttacggtacctaaaccgtttttaacgtttaaaccgttcggttacctaagttaccgaaggtaaacgtttaaccctttacccgttttaacccttacctaaacggtttaacgtaacgttacccctaacccggtttacccgggaacccggtaaacggggtaaccctaaccgggtaacccgttaaggggtaacgtaaacgtttaaaaacccggg

SEQ ID NO: 172122 - DNA, 658 bp, Homo sapiens
  misc_feature: GYAE6OF02J0SJY.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaagganaaagtcacatcacctgccgggccagtcagagcgttggagtagcttacactggtaccagcagaacgcaggtcagtctaccaaagctcctcatcaagtatcgccttccagttcctcgtcgacgggtcccctaggtagttcagtggcaggtggatcggtaggaccactactttccaccccgtcaacccgtattacccaagtaccgacccgtaggaacgtactaggaaacgtatcgtctacgtaccttaaactttagttaaccttcggttactaactaccggtaacgtaggtttaaccctttaaccgttttaacccgtaactaacggttacgtacttacccgtaacccgtttaccgggaaccgtaaacgggtaccaaccggtacgttaggaaccggtaaacgttaaaccgtacgtgggttaccggactacggtaaccaacccgtattaccgttacgtaccttaaccg

SEQ ID NO: 172123 - DNA, 608 bp, Homo sapiens
  misc_feature: GYAE6OF02IVL7K.27.78.H01.1.454.CMB.1.raw
  modified_base (372)..(372): a, c, t, g, unknown or other
  misc_feature (372)..(372): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctcagactttcagtctgtgactaccaaaggagaaagtcaccatcacctgccgggccagtcagagtcgttggtatagcttacactggtacagacagaagccaggtcagtcctaccaaagcctacctcatacaagtatcgccttaccctacgttcccttctccgtaccgggggttcccctcggtacggttcgaggtcggaaaaacnggtaggtactcgtagggacactactttacaccctcaaccatacaatacgtaccgtaggaacgcgtaggaagatcgctgaactaacttattactcgtacatacagtacgttaccttaactttacctacgaacgttgacttccgtaaccgttccggaaccgaaggtaccgacgtacgtaggtaacgtaacttaaacggactaggtggtacctacgactacctacgttcgtacgttccg

SEQ ID NO: 172124 - DNA, 573 bp, Homo sapiens
  misc_feature: GYAE6OF02GNWHB.27.78.H01.1.454.CMB.1.raw
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatgccttcccagtccttctcgacgggtcccctcgtaggttcaggtggcagtggatcgtgggacactatttccaccctcaccatcaatagtcgtaggaagctagaagatgactgactaactttattaccttgtacactacagtacgttaccttactttacctatagtntacttacctaccgttccggaccgaaaggaccacgtacgtaggtaacgtaacgttaaaccgacgttcggtacggtacgttacgacctaacctacgtccttcgttacttaccg

SEQ ID NO: 172125 - DNA, 520 bp, Homo sapiens
  misc_feature: GYAE6OF02IJFUP.27.78.H01.1.454.CMB.1.raw
  modified_base (453)..(453): a, c, t, g, unknown or other
  misc_feature (453)..(453): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttccagtccttctcgacggggtcccctcgaggttcgagtggcagtggatcgtgggacactatttccaccctcaccatcaatacgcctaggaagctagaagatgctgactaacttattactgtcatcagtacgtactactttacctctaagtnatcctacttcggaccaaggtacacgacgtggataattaacgacgtgtagctgccaccattcctgtcc

SEQ ID NO: 172126 - DNA, 546 bp, Homo sapiens
  misc_feature: GYAE6OF02GNVXL.27.78.H01.1.454.CMB.1.raw
  modified_base (178)..(178): a, c, t, g, unknown or other
  misc_feature (178)..(178): n is a, c, g, or t
  modified_base (228)..(228): a, c, t, g, unknown or other
  misc_feature (228)..(228): n is a, c, g, or t
  modified_base (382)..(382): a, c, t, g, unknown or other
  misc_feature (382)..(382): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaattgtgctgactcagtctccagactttcagtctgtgactccgaaagganaaagtcacatcacctgccggccagtcagagcgttggtagtagcttacactggtaccagcagaacgccaggtcagtcctaccaaagctcctacatacaagtactcgccttccagtcctctcgacgggtccctgacgttcagtcgcagtggatcgnggacacgtacttccaccctcaccactacaactacgcctaggacgactagagatgcngtactaacttactacgtctcatcagagttacttacctttactactagtacacttaccgtaccgttaccggaccgaacggaccaacggtacgtaggacgtaagtaaacg

SEQ ID NO: 172127 - DNA, 558 bp, Homo sapiens
  misc_feature: GYAE6OF02HYTFN.27.78.H01.1.454.CMB.1.raw
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctctcatcaagtangcttccagtccttctcaggtcccctgaggttcagtgcagtgatcnggacacattcaccctcaccatcaatacgcctaggacgctagaagtangactgctaacttattactgtacatacagtacgttacttaacctttacctactaagtcgacttaccgaccgtttacggaccgtaagggacctacggacgttaggaacgtaacgtttaaacgaacgttggacggttaccgtagacccaaccgtacttccgttagtttacccg

SEQ ID NO: 172128 - DNA, 641 bp, Homo sapiens
  misc_feature: GYAE6OF02IV6VI.27.78.H01.1.454.CMB.1.raw
  modified_base (294)..(294): a, c, t, g, unknown or other
  misc_feature (294)..(294): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctcaaagctcctcatcaagtacngcttcccagtccttctcgacgggtccctgtacggttcagtgcaggtgatcgtagggacacgtacttccaccctcacctataccaatacgtcctaggaacgtcgtagaaagagttgactagtacctaaacgtttacttaacgtgttaccaattaccgtaagtactttaaccttaacgtttacccttaacgtaacgtcgtaacttacccttacccgtttaccggaaccccgaaaagggggttaccaacccggttaacgtacggggtaaacgtaaaccttaaaaaccggacgttaacgggtcgtaccgttacgacccgtaacctacgttcccgttagttccctttaaccg

SEQ ID NO: 172129 - DNA, 698 bp, Homo sapiens
  misc_feature: GYAE6OF02IFOWU.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaaattgtgctgactcagtcctccagactttcagtctgtgactacaaaaggagaaagtcacatcaccgtggcccgggccagtcaaggagtcggttaggtagtagtactactacgtacggtaccaggaccaagaacgtaccgaggtacacgtactaccaaagtcctctacatacaagtactcgccttaccacgtttcctcctcggtaccggtcccctacggtacggttccgaggtcgacgtacggttcggacgtcggtacgggactaaccgttactttacccgtacccctacctaaccgactaacgtaacgtacgtacccggttaaggaaacgtcgtaaaggtaaccgtaagtcggtaccgttacgtaaccttaaaactttaccgttaactttacggtactactttaacgaacgttaaacgtttacctttaacctttaccgtaacgtacgtaacggtactaccgtaaccgttaccgacggaacggtactaccggtacgtacggtaacgtaacgttaaacgg

SEQ ID NO: 172130 - DNA, 593 bp, Homo sapiens
  misc_feature: GYAE6OF02F5WMJ.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatctgggacacgattcaccctcaccatcaatagcctggaacgctgaagatgactgactaacttattactgtactatacgagtacgttacttacctttaacctactaaagttcgtaacttccgtaacccgtttacgggacccgtaaacggggaccaccggtaacgtacggggtaaacgtaacgtttaaaaccggtaacgttaggtacggtacgttacggaccaacccgtacgttccgtacgtttacccg

SEQ ID NO: 172131 - DNA, 745 bp, Homo sapiens
  misc_feature: GYAE6OF02FF33Y.27.78.H01.1.454.CMB.1.raw
  modified_base (143)..(143): a, c, t, g, unknown or other
  misc_feature (143)..(143): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctcagggtnaattgtgctgactcagtctccagactttcagtctgtcgactaccgaaaggcaaacgtcaccatcaccgtgccgggtcagtcaggagcgttggtatacgtcttaccgacgttcggtaccagcagtaacgcccgtaggtccacgtcctacccgaaagtcctcctacacgttacgaagtactcgtaccttccgtagttcccttcgtccggtaccgggttcccctacggtacggttcgacggtcggtacaggtacgtacgttcgtacgggtaccaccgttacctttacccacccttacaaccctagtacccgtaagttacccggacccgtaagggtaaccgtacgttaacgggaaactacgttacggtaccttacgggttaacccttaaccgtttaacgtttaccgtacgtaacctacgtaccgtaacgttaaccgtttacctttaaaccctttacgaacgtacgtacgtaacgttaccttaacccgggtcgaaaccggtaacggaccgtaaccgtacgaacggtacgttaaacgaaccggttacgtacggtacgtaccttaccggaccttaacccgtcttacccgttacgttacccttaccccgg

SEQ ID NO: 172132 - DNA, 600 bp, Homo sapiens
  misc_feature: GYAE6OF02HIRHX.27.78.H01.1.454.CMB.1.raw
  modified_base (154)..(154): a, c, t, g, unknown or other
  misc_feature (154)..(154): n is a, c, g, or t
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttggggggtcgagtgagcaaaactagacaagtcaaggcaggaagatgttgccatcacaactcattgggtttctgctgctctgggttccagcctccgaggggtnaaattgtgctgactcagtctccagactttcagtctgtgactccaaaaggagaaagtcaccatcactgccgggccagtcagagcgttggtagtancttacactggtaccagcagaagccaggtcagtctacaaagctccncatacaagtangccttaccacgtccttctcgacgggtcccctgacggttcaggtcgactagtggactcgtgggaacacgtatttccaccctcgaacctntacaagtacgtaccgtaggaacgacgttagaaacgtatcgtctacgactaaaccttagttaactcgtanacgtanaggtaattaacctaactttaacctcaagtgtactacctaccgttcggaaccgtaaggaacccaacgtacgtagaaagttaacgtaaaactaacgtgtacggtactacgaccgtaacctacttcgttgttaccc

SEQ ID NO: 172133 - DNA, 538 bp, Homo sapiens
  misc_feature: GYAE6OF02G3D24.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtgcagtggatcgtgggacacatttccaccctcacctatcaatcgcctggaagctagaagatgctgactaacttattactgtctatccagtacgtacttactttacctctaagtcgaacttccggcctttaccggaccgtaacgggccacgacgtaggacgtagttaaaccgg

SEQ ID NO: 172134 - DNA, 534 bp, Homo sapiens
  misc_feature: GYAE6OF02G4JCQ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgataagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtggcagtggactcgtgggacactactttccaccctcaccatcaaatacgcctggaagctagaagatgctgcctaactttattactgtacatacagtagttaccttactttacctacaagttgactcaccgttcggaccgaacgggacacgacgtggagagttaaacg

SEQ ID NO: 172135 - DNA, 589 bp, Homo sapiens
  misc_feature: GYAE6OF02HU3Q0.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccaggcagaagccaggtcagtctccaaagctcctcatcaagtatgcttcccagtcccttctcacggggtcccctgacggttcagtggcagtggatctgggacacatttcaccctcaccatcaatcgcctggaagctagaagatgctgctaaactttattactgtacatacgagtacgttacttaaccttttacctactaagttgtaacttcctaacccgtttacggacccaaacggggacctaccggtacgtagggaacgtaaactttaaaaccggaacgttacggttacggacttacgggacccaacccgtaacttccgttagtttaccccg

SEQ ID NO: 172136 - DNA, 523 bp, Homo sapiens
  misc_feature: GYAE6OF02HCDV5.27.78.H01.1.454.CMB.1.raw
  modified_base (392)..(392): a, c, t, g, unknown or other
  misc_feature (392)..(392): n is a, c, g, or t
  modified_base (444)..(444): a, c, t, g, unknown or other
  misc_feature (444)..(444): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatcgtgggacacatttcaccctcaccatcaatcgcctggaacgctagaagntgctgactaacttattactgtcatcagagttaccttactttacctataagtnacttcaccgttcggaccaaagggaccaacggctaggagtaattaaacgactgtcgactgaccactatcttgtacttccg

SEQ ID NO: 172137 - DNA, 637 bp, Homo sapiens
  misc_feature: GYAE6OF02IL3FT.27.78.H01.1.454.CMB.1.raw
  modified_base (245)..(245): a, c, t, g, unknown or other
  misc_feature (245)..(245): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
tcagagcgtcgtctcacgaccggtgctcgatttagtgtgagtagtttgggtttggggagtgagcaaaactagacaagtcaaggcaggaagatgttgccatcacaactcattggtttctgctgctctggttccagcctccaggggtgaaattgtgctgactcagtctccagactttcagtctgtgactccaaaggagaaagtcaaccatcacctgccggccagtcagagcgttggtagtagcttanactggtaccagcaagaagccaggtcagtctacaaagctcctacatcaaaggtactcgcctttacccagttccctttcgcgacggggtcccctgacggtttcaggtcgcagtggactcgtggacnctattccaccctnaaccatcaactagccgtaggaanctagaaacgntagtctacgactaaacctttattaccgtgttacgaactacgtaagtaacgttaaccttaacttttaaccgactaagttaagacgttcctaaccgttacgtacccggaaaaggacctaaccggtaacgtcggggtaaataaaccggtttaaaaacggaaacgttcggtacggtacgtacggtaacccaaacccgtatttaccgttcggttacccctttaacgg

SEQ ID NO: 172138 - DNA, 610 bp, Homo sapiens
  misc_feature: GYAE6OF02I9AQF.27.78.H01.1.454.CMB.1.raw
  modified_base (406)..(406): a, c, t, g, unknown or other
  misc_feature (406)..(406): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcacgtctaccaaagctcctcatacaagtatgccttcccagtccttctcgacggggtcccctggaggttcagtggcagtgatcgtggacatactttacaccctcaccatcaatacgcctaggaagtcgtaggaagntcgtctagtacctaacttatttacgtgtacctatactaggtaacttaccttacctttaaccgtacaaagttcgtacttaccgtaaccgttcccggaccgtaaacgggacccaacggtacgtacggggtaaacgtaaacgtttaaaaccggaacgttacggtacggccgttacggaccctaaccgtacttccgttacgttacccg

SEQ ID NO: 172139 - DNA, 673 bp, Homo sapiens
  misc_feature: GYAE6OF02H9SYK.27.78.H01.1.454.CMB.1.raw
  modified_base (181)..(181): a, c, t, g, unknown or other
  misc_feature (181)..(181): n is a, c, g, or t
  modified_base (484)..(484): a, c, t, g, unknown or other
  misc_feature (484)..(484): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgtgccatcacaactcagttgggtttctgctgctctgggtccacgcctcgaggggtanaattgtgctgactcagtctccagtactttcagtctgtgactaccgaaaggagtaacgcacatccaccgtggcccggacagtcgaagtcgtcggttagtagtacgaccttacacgtacggtacaacgacgaaacggaacgccgtaacggtacgaacgttccacctaaacgtcctacctacactacgtaagtactcgtccttaccctacgtccttccgtaccggtaccggggttcccctagggtaccgtttacgaggttcggactagggtacggtatcggtacggtaactaacttccgtttaccncccgtaacacaactacactaacgcctaaggaacgtactaggaatagtacgcctagtaacccgttaatttattaaccgtgttacactacgtaactaacgttaccttaacttacctagtacgtaaacgtcttactacccggtacgaacccggaagtaaccgtacgtaacgaacggtacgtaaagtaaaccg

SEQ ID NO: 172140 - DNA, 574 bp, Homo sapiens
  misc_feature: GYAE6OF02GV2DB.27.78.H01.1.454.CMB.1.raw
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtntcgcttcccagtccttctcacggggtcccctcggaggttcagtggcaggtggatcgtgggacactatttccaccctcaccatcaatacgcctggaacncgtagaagatcgctgactaacttattactgtcatcagtattactactttacctacgtaagtagtactccgtaaccgtttccggaaccgtaacgggacctacggacctagggaaacgtaacgttaaacggaacgtttaggtacggtactacggtaccaccgtacttcgtacgtttacccg

SEQ ID NO: 172141 - DNA, 575 bp, Homo sapiens
  misc_feature: GYAE6OF02GTVOH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggttaaattgtgctgactcagtctccagtactttcagtctgtgactccaaaggagaaagtcaccatcacctgccgggccagtcagagcgttggtagtagcttacactggtaccagcagaagccaggtcagtctccaaagctcctcatcaagtatgccttcccagttccttctcgacggggtccccctcggtacggttcaggtggcaggtggatcgtagggaccactactttccacccctcaccctataccaaacttacgccctagggaacgtctagaagatcgctcgactaactttattactgtcattcaagtacgtaaccttactttacctactaagtgacttcctaccgttccggaccgtaacgggacaccggtactaggagtaactaaacgtaacgg

SEQ ID NO: 172142 - DNA, 655 bp, Homo sapiens
  misc_feature: GYAE6OF02GIC3L.27.78.H01.1.454.CMB.1.raw
  modified_base (328)..(328): a, c, t, g, unknown or other
  misc_feature (328)..(328): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccggccagtcagagcgttggtagtagcttacactggtaccagcagaagccaggtcagtctccaaagctcctcatcaagtancgcttcccagttcccttctcgacggggttcccctggacggtttcaggttcggacaggtggactcgtaggggactacgtacttttccgacccctccaaccactaccaacgtacgccgttagggaaacgtcgtaggaaagtatcggaccttagacctaaacttttattaccgttacgtactaatacaacgtaacgttaaccttaaccgttttacctaacgtaacggttcgtaactttacccgtaacccggtttaccggtaacccggaaacggggtaaccctaaaccgggtaaccgttacgggtaaacggtaaacgtttaaaaacccggg

SEQ ID NO: 172143 - DNA, 572 bp, Homo sapiens
  misc_feature: GYAE6OF02FX6B8.27.78.H01.1.454.CMB.1.raw
  modified_base (426)..(426): a, c, t, g, unknown or other
  misc_feature (426)..(426): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggcagtcagagcgttggtagtagcttacactggtaccagcagaagccaggtcagtctaccaaagctcctcatacaagtatgtcttcccagtccttctcgacgggtccctcgagttcagtggcaggtgatcgtgggacactactttccacccgtcaccataccaatacgccgttaggaancgtagaagatcgctacgactaacttattactgtactaatcaagtacttaacttacctttacctactaacgttgacttacccgtaacccgtttccggacccgtaagggtaccaaccggtacgtacgggaacgtaacgttaaaaccgg

SEQ ID NO: 172144 - DNA, 643 bp, Homo sapiens
  misc_feature: GYAE6OF02JGPHU.27.78.H01.1.454.CMB.1.raw
  modified_base (178)..(178): a, c, t, g, unknown or other
  misc_feature (178)..(178): n is a, c, g, or t
  modified_base (281)..(281): a, c, t, g, unknown or other
  misc_feature (281)..(281): n is a, c, g, or t
tcagagcgtcgtctcacgaccggtgctcgatttagtgtgagtagtttgggttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgactccgaaaggagaaagtcaccatccacctgccggcagtcagagtcgttaggtatagtcttacncgtggtaccagcaagaacgccaggtcagtctaccaaagtcctctcatacaagtactcgtccttacccagttcccttctcgaacggggttcccctggtaacggtttcaagggttcggaccgtaggtggacttcgtcgggactaactacgtttccaacccgtcaaccactacaacgtacgcccttaggaactaccgttagaacgtatcgcgttacgtaacgttaacctttacgttaaccgttcgtactactacgtaacgtaacgttacctttaacctttacctacgttaacggttcgaacttccgtacccgttacggaaccgtaacggggactacccggacgtacggacgttaacttaaaccgg

SEQ ID NO: 172145 - DNA, 542 bp, Homo sapiens
  misc_feature: GYAE6OF02GSHD7.27.78.H01.1.454.CMB.1.raw
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcagggtcccctcgtaggttcagtggaagtggatcgngggacanttcacctcacatcatagcctggagctagaagatgctgctaacttattactgtcatcgagtactacttaacttacctactaagttcgattcctaccgttaccggaccgaacgggacctaacggacgtaggaagtaacgtttaaccgaagttcggg

SEQ ID NO: 172146 - DNA, 623 bp, Homo sapiens
  misc_feature: GYAE6OF02IWFNW.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacactggtaccagcagaagccaggtcagtctccaaagctcctcatacaagtatgccttcccacgtccttctcgtacgggtccccgtcgaggttcaggtggctaggtgagtcgtggacactactttccaccctcacctatacaactagtccgtaggaacgctagaagtagtcgtactcgacctaacctttattaccgtacgtactacttacgaagtaccgtttaacttaaccgtttaacctacgtaacgttacgtacgttaccgtaccctttacggacccgtaaacgggaaccgacgtacgtaggtaacgtaaacgttaaacggtacgtaggttacggtacttacgacctaccgtacgttacctttacgtacctttaccg

SEQ ID NO: 172147 - DNA, 606 bp, Homo sapiens
  misc_feature: GYAE6OF02GZ57V.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtcctaccaaagcctcctcatacaagtatcgccttcccagttcccttctccgtacggggtccccttcggtacggttcgagtggctaggtggagttcgtagggactacgtactttccaccctcacctactacaacgtacgaccgttagggaacgtccgtaagaagacgtcgactcggtaccttaaactttacgttactttagtacctatacaagttacgttaaccttacctttacctactaagtcgtaacttcctacccgttacgaaccgtacggaccacgagtacggaagtaactaaacgtacgtagtcgactcgaccactacgtcgtctaccg

SEQ ID NO: 172148 - DNA, 774 bp, Homo sapiens
  misc_feature: GYAE6OF02JUERV.27.78.H01.1.454.CMB.1.raw
  modified_base (755)..(755): a, c, t, g, unknown or other
  misc_feature (755)..(755): n is a, c, g, or t
  modified_base (766)..(766): a, c, t, g, unknown or other
  misc_feature (766)..(766): n is a, c, g, or t
tcagagcgtcgtctcacgaccggtgctcgatttagtgtgagtagtttgggtttggggtagtgagcaaaactcgacaagtcaaggcagagatgttgccatcacaactcatgggtttctgctgctctgggttaccagtcctccaggggtgaaattgtgctggactctaagtctccagtactttcagtctgtgacctcgaaaggagaaacgtcgaccattcgacctggcccgggtccgagtccaggagtccggtttggaacgtgccttacgctagggttacccagtccagaacggcctaaggtcacgtcttaccgaaacgtccgtaccttccatactaacggttactacggtacctttacccgtaggttaccctttacgtccgtacggggttccccgtacgggttacggtttacgaacgggttcggacgtaacgttagggtacgttacgtacgggtaacttactaactttaccctaccccggttaccaaccgtactaccgtaaacgttacgaccgttacggaacgttacggttaacgaacgtacgttcgtacgttacggaaccttaacctttacgttacgttactacctaacttacggtaaacgtaaccgttacctttaacgttacccgttaacgtacgtaacgtcctaccgttaacgttaccggtaaacccggtagggtactaccggtacgttaagtaacggttaacgttaaaccggaacgttggtaccggtacttcggaaccgttgtaaccggttnttacccggttntaaccccg

SEQ ID NO: 172149 - DNA, 738 bp, Homo sapiens
  misc_feature: GYAE6OF02I0N4A.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagactttcagtctgtgactccaaggagaaagtcacatcactgccggcagtcagagcgttgtagtagacttacactggtaccagcagaagccaaggtcagtctaccaaagcctcctacactactaagtatacgtccttaccacgttcccttacctccgaaccggggtccccttacggtacggttacacggttcggtaccgtaggtcgggtaatccgtacggggacctaactacgtttaccaaccccgtcctaacccgtatacgtaactacgacccgttagggaaacctccgttagaaacgtacgtacgtaccgttacggtaccttaaaaccgtttttacgttaaacccgttcgggttaaccgtaaactttccgaaaacggttaaccgtttaaacccgttttaaaccgtttttaaccccgtaacgttaaacggttaaccgtaacgtttacccgtaaaccccggtttaccggaacccggtaaacgggtaaccctaaccgggtaacccgtttaagggaacgttaaccgtttaaaaacccggg

SEQ ID NO: 172150 - DNA, 581 bp, Homo sapiens
  misc_feature: GYAE6OF02FO4MX.27.78.H01.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggngaaagtcaccatcacctgcccgggccagtcagagcgttggtagtagcttacactggtaccagcagaagccaggtcagtctaccaaagctcctcatcaagtatgccttcccagtccttctcacggggtcccctggagttcagtggcagtggatcgnggacacactttccaccctcaccataccaatgcctaggaacnctagaagatgctgacctaacttattacgtntaccatcgaagtacgttacttaccttttaccactaagtcgtaacttccgtaaccgttccggacccgtaaagggacctaaccggacgtagggaacggtaacgttaaaaccggtaacgtggtacgtacgtacgacctaccgtagttcttcgttacttaccg

SEQ ID NO: 172151 - DNA, 535 bp, Homo sapiens
  misc_feature: GYAE6OF02G0TEZ.27.78.H01.1.454.CMB.1.raw
  modified_base (231)..(231): a, c, t, g, unknown or other
  misc_feature (231)..(231): n is a, c, g, or t
  modified_base (433)..(433): a, c, t, g, unknown or other
  misc_feature (433)..(433): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactccaaagganaaagtcaccatcacctgccggcagtcagagcgttggtagtagcttacacgtggtaccagcagaacgccaggtcagtctccaaagctcctcatcaagtatgcttccagttccttctcgacgggtcccctcgtacgttcagtgcagtggatcgtggacactatttcacccctcaccatcaatacgccgtaggactcgtagaagntgctgacctaacttacttactgtcatcagtactacttacttacctntaagtnactcctaccgttcggaccgtaacggacacgtacgtaggactagtaaccgg

SEQ ID NO: 172152 - DNA, 577 bp, Homo sapiens
  misc_feature: GYAE6OF02HGFPO.27.78.H01.1.454.CMB.1.raw
  modified_base (218)..(218): a, c, t, g, unknown or other
  misc_feature (218)..(218): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtnactccaaaggagaagtcaccatcacctggccgggccagtcagagcgttggtagtagcttacactggtaccagcagaagccaggtcagtctccaaacgctcctcatcaagtatgccttccatccttctcgcggggtcccctcgaggttcagtggcaggtggatcgtggacactatttcaccctcaccatacaactacgacctaggaacgactaggaatagtgcgtgacctaactttatacttgtacatacagtacgtaacttaactttaccctactaacgttgtaacttaccgtacccgttaccggacccgtaacgggtaccgaacggttaccgtagggtaacgtaagtttaaaaccggg

SEQ ID NO: 172153 - DNA, 563 bp, Homo sapiens
  misc_feature: GYAE6OF02HDEEM.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctggccgggccagtcagagcgttggtagtagcttacactggtaccagcagaagccaggtcagtctccaaagcctcctcatcaagtatcgcttcccagtccttctcacggggtcccctcggacggttcagtggcaggtggatcgtgggacactactttccacccctcacccatccaatacgccctaggaacgctagaagatgctgacctaacttattactgtcactcagagttactacctttacctactaagtcgtactccgtacccgtttcggacccgtaagggaccgaaccgtacgtacggaacgtaagttaaaccgg

SEQ ID NO: 172154 - DNA, 498 bp, Homo sapiens
  misc_feature: GYAE6OF02JB199.27.78.H01.1.454.CMB.1.raw
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
  modified_base (488)..(488): a, c, t, g, unknown or other
  misc_feature (488)..(488): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcacctcaccatcaatagcctggaanctgaagatgntgcaacttattactgtcatcagaatctaacttactacaagtnatcaccttcgaccaaggacagactaggagaattaaacgatagtgctgcaccntctgtcttac

SEQ ID NO: 172155 - DNA, 537 bp, Homo sapiens
  misc_feature: GYAE6OF02HCK3P.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtccctcgaggttcagtggcagtggatcgtgggacacgatttcaccctcaccatcaatacgcctggaagctagaagatgctgacaacttattactgtcatcagtacgtactactttaccactaagtgtatcaccgttacggaccaagggaccacgacgtagggaagtaacttaaacggaacgtcggtaggtctacggaccacctacttctagttacc

SEQ ID NO: 172156 - DNA, 564 bp, Homo sapiens
  misc_feature: GYAE6OF02GFHFP.27.78.H01.1.454.CMB.1.raw
  modified_base (179)..(179): a, c, t, g, unknown or other
  misc_feature (179)..(179): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctggccggccagtcagagcgttggagtagcttacactggtaccagcagaagccaggtcagtctaccaaagcctcctcatcaagtatgccttcccagttcccttctcgtaccggggttcccctcggaggtttcaggtcggcaggtggactcgngggacactactttccaccctcaccatacaatacgcctaggaanctagaagntgctgacctaacttattactgtactatcgagtaacgttaaccttacctttacnctaagtnattcctaaccgttcggaccgaacgggaccaccggtactacggtaagtagttaaaccgg

SEQ ID NO: 172157 - DNA, 548 bp, Homo sapiens
  misc_feature: GYAE6OF02IG3VG.27.78.H01.1.454.CMB.1.raw
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctacatcaagtatgcttcccagtccttctcgaggggtcccctgacggttcagtgcagtggactcgtggactacactttccaaccctcaaccatacaactacgacctggaaacgctagaagatcgctcgtactaactttacttactcgtactatcaagacgttacttacctttacctacaagtagactactccgtacggaccaacgggacacgctacgggataacgtaaacgacgtagtgcgtacgccacacgtctgttacc

SEQ ID NO: 172158 - DNA, 684 bp, Homo sapiens
  misc_feature: GYAE6OF02FVU4V.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccagactttcagtctgtgactccaaagganaaagtcaccatcacctgcccgggccagtcagagcgttggtagtagcttacactggtaccagcagaagccaggtcagtctacaaagctcctcatcaagtatgtccttcccagttcccttctccgtacggggtccccctcggtacggttcaggtggacaggtggatcgtgggacactacgtttccacccctcaccatacaacgtacgacccgtaggaagctagaaagacgttgactacggaccttaaactttacgtttaaccttggtacctaacgttactaacggtaacgttttaaccctttaacctttttaacccgtaacgttaacgttcgtaacgttaccccgttaacccgtttacccggacccggtaaaacggggtaccgtaaccggtacgtaagggtaaccgttaaacgttaaaaccgtacgttcgggtacggtaccgttaccggaacctaacccgtagtttcccgttagtttaccctttacccg

SEQ ID NO: 172159 - DNA, 583 bp, Homo sapiens
  misc_feature: GYAE6OF02H4HVW.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaacgccaggtcagtcctaccaaagcctcctcatcaagtactgccttccagtcccttctcgacgggtccctgaggttcagtcgcaggtggactcgtagggacactactttccaccctcaacctatcaactacgccgtaggaacgtctagaagtacngacttgactaaactttaacttactacgttacaatcaaggtaacttacttacctttacctactaagtcgtaacttccgtaaccgttccggaaccgtaacggaacgaccggtaacgtagggacgtaacgttaaaccgg

SEQ ID NO: 172160 - DNA, 670 bp, Homo sapiens
  misc_feature: GYAE6OF02GT0IV.27.78.H01.1.454.CMB.1.raw
  modified_base (366)..(366): a, c, t, g, unknown or other
  misc_feature (366)..(366): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccggccagtcagagcggttggtagtagtcttacacgtggtaccagacagaacgccaggtcagtctacaaagcctcctcactacaagtactgaccttccgacgtcctctcgacgggtccctacgtaggttcagtcggcgagtgagttcgnggaacagtacttcgaccctcgacctatacaagtacgcgtaggacgacgtaggaatagtcgtactaggtaaccttaaactttaattaccgtgttaacgtactactaacggtaacttaacctttaacccgtttaacctacgtaacggttagtaacctttacctaacccggtttacggaacccgtaaacggggaaccgtaaccggtacggtaacgggtaacgtaaaccggtttaaaacggtaccggttacggttacggacccgttacggaaccccgttaaccacgttttccgtacggttttaccccg

SEQ ID NO: 172161 - DNA, 562 bp, Homo sapiens
  misc_feature: GYAE6OF02FWCE9.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgccttcccagtccttctcgacggggtcccctcggaggttcagtggcagtggatcgtgggacacatttcaccctcacccatcaatagcctggaagctgaagatgctgacaacttattactgtcattcagtagtaccttactttacctataagtcattccacctttcggacctaaagggacctaccggactagggaacgtaagttaaaccggtaacgttcgttagggccttacggaccctaacccgtattccgttacgttccttacccg

SEQ ID NO: 172162 - DNA, 697 bp, Homo sapiens
  misc_feature: GYAE6OF02GQBPP.27.78.H01.1.454.CMB.1.raw
  modified_base (332)..(332): a, c, t, g, unknown or other
  misc_feature (332)..(332): n is a, c, g, or t
tcagagcgtcgtctcacgaccggtgctcgatttagtgtgagtagtttgggtttggggatgaggcaaaactgacaagtcaaggcaggaagatgttgccatcacaactcattgggtttctgctggctctgggttccagcctccaggggtgaaattggtgctgactcagtctccagactttcagtctgtgactccaaaggagaaagtcacatcaccgtgccgggcagtcagagcgttggtagtagcttaacactggtaccagcagaagcctaaggtcagtactaccaaaagcctacctacactactaaggttaactgtacctttcccagtccttntccgaggggttcccctacgtagggttcaggttcggactacggtgggtatcgtggggacctaacgtagttttaccacccctcaaaccctatacgaaacttaggacccgttaggaaacgtcgtcggtaaaacgtgttaacgcttacgaaccgtaaactttacttaacgttacggttactaacttaccgaacgtaagttaaccttaaccttttaacccgacgttaaaacgttgtaacctaccgttaaccgttaccggtaacccgtaaagggtacccgaacgtacgtaacgggtaataaacggttaaaaccgttacgtacggttacggtactacggtacacccggtactcccggttatacctttaaccg

SEQ ID NO: 172163 - DNA, 674 bp, Homo sapiens
  misc_feature: GYAE6OF02G4NAY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacgggtcccctggtacggttcagtggcaggtggatcgtgggactacgtatttccaccctcaccctactacaactacgtaccgtaggaaacgccgtaggaaagtagtcggaccttaggaccttaaactttaacgttaaccttacggttacctaatacgtaagtaacgtttaaccttaaccgttttaaccctacgtaacgttacgtaacttaccgtaacccgtttaccgggacccgtaaaacggggtacctaacgaccggttagggtaaacggttaaacgtttaaaaaccggtaacgttacggttacggtaccgttacggtacccgtaacctaacgttcccgttaggttaccctttacccg

SEQ ID NO: 172164 - DNA, 607 bp, Homo sapiens
  misc_feature: GYAE6OF02I6V2O.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcactacaagtatcgccttcccagttccttcgtcgtacggggtcccctcggtacggttcaagtggacaggtggatcgtggactacgtacgttcaccctcaccatacaatacgcctaggaacgtcgtagaacgtatcgcgtagactaaccttattaccgttagtacactacgaacgtacgtttaaccttactttacctaactaagttcgaacttccgtaccttccgggaacctaacgggacctaacgtacgtacggaacggttaacgttaaacgtacgtcggtacgacgttacgacctaccgtactcgttacgttccttaccg

SEQ ID NO: 172165 - DNA, 596 bp, Homo sapiens
  misc_feature: GYAE6OF02HQ5A5.27.78.H01.1.454.CMB.1.raw
  modified_base (449)..(449): a, c, t, g, unknown or other
  misc_feature (449)..(449): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagagccaggtcagtctccaaagctcctcatcaagtactgccttcccagttcccttctccgtaccggggtcccctacggtaggttcgagtcggctaggtggattcgacgggtacactactttccaccctcaccatacaatacgccgtagaacgctagaacgntacgctagactaacttattactgtacacgtacgtacgtaacgttaccttacctttaccttacgtaacgttgtaccttaccgtacccgtttaccggaccgtaaacgggaccctaacggtaccgtaacgggtacgtaacgttaaaacgg

SEQ ID NO: 172166 - DNA, 762 bp, Homo sapiens
  misc_feature: GYAE6OF02JPO9F.27.78.H01.1.454.CMB.1.raw
  modified_base (195)..(195): a, c, t, g, unknown or other
  misc_feature (195)..(195): n is a, c, g, or t
  modified_base (272)..(272): a, c, t, g, unknown or other
  misc_feature (272)..(272): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaagganaaagtcaccatcacctgccgggccagtcagagcgttaggtagtagcttacactggtaccagcagagccagtcagtcncaagctcctcatacaagtatcggtccttacccacgttccttacgtccgtaaccggggtccccttcggtaaggttccgaggtcggaccgtaggtcggaacttcgtacggggacaccgttacgtttacccaaccccgtccaaccctagttaccaaacgtacgtacccgttagggaacctacgtacgaaagtacgtcggtacgtacgaaccttaaacctttaagtttaaccttacggtaacttaacgttaccgtaaacggtaacgttttaaccctttaaccgttttaaacccgttaccgtaaacgtttaccgttaacgttaccccgttaacccgtttacccggggtaaccgtaaaacgggtacccgtaaacccgggtacgttaacgggaaacggttaaacgggttaaacccgttaacgttagggttaaccgccggtttaaccgtaccccgtaacccggttacgtttcccgtttacggttaccccctttaaccg

SEQ ID NO: 172167 - DNA, 559 bp, Homo sapiens
  misc_feature: GYAE6OF02G2GY5.27.78.H01.1.454.CMB.1.raw
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctctcatcaagtatgcttcccagtccttctcagggtcccctgaggttcagtggcagtggatcgtgggacactatttccaccctcaccatcaatacgcctaggaacnctgaaagntgctgctaaactttattactgtactatcagtagtacttactttacctactaagtgattcctaccttacggccgtaaacgggaccaccgtacgtcgggaagtaacgttaaaaccgaacgttcggtacggtcctacgtaccacctacttacgttcgtcgtttaaccc

SEQ ID NO: 172168 - DNA, 511 bp, Homo sapiens
  misc_feature: GYAE6OF02GDDQ0.27.78.H01.1.454.CMB.1.raw
  modified_base (195)..(195): a, c, t, g, unknown or other
  misc_feature (195)..(195): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatcgtgggacacatttcaccctcaccatcaatacgcctaggaagctagaagatgctgctaacttattactgtcatcagagttactactttaccntaagtgactctaccgttcggaccaagggacacgacgtggagtaataaacgactgtgactgcaccatctgtcttac

SEQ ID NO: 172169 - DNA, 520 bp, Homo sapiens
  misc_feature: GYAE6OF02F3ONW.27.78.H01.1.454.CMB.1.raw
  modified_base (392)..(392): a, c, t, g, unknown or other
  misc_feature (392)..(392): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcaggagcgttggtagtagcttacactggtaccagcagaagccaggtcagtctccaaagctcctcatcaagtatgcttcccagtccttctcacggggtcccctcgaggttcagtggcagtggatcgtgggacactatttccaccctcaccatcaatagcctagganctgaagatgctgactaactttattactgtcatcagtagtacttacttacctctaagtctactcaccttcggaccaagggaccacgactaggaagaacttaaacgactgtaggctcgcacactctgttc

SEQ ID NO: 172170 - DNA, 666 bp, Homo sapiens
  misc_feature: GYAE6OF02GH1YF.27.78.H01.1.454.CMB.1.raw
  modified_base (227)..(227): a, c, t, g, unknown or other
  misc_feature (227)..(227): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctcaggggtgaaattgtgctgactcagtctcagactttcagtctgtgactccgaaagganaaagtcaccatcactgccggcagtcagagcgttggtagtagcttacacgtggtaccagcagaacgccaggtcagtcctacaaagctacctcatacaagtatgaccttccacgttccttcgtcgacggggttcccctaggtacggttccaggtcggacaggttcggactcgtacggggactaaccgtacttttacccaccccgtaccaaccaacttacaaacgttaacgtacccgtaagggaacgtaccttagggaaacgtagtacggtaccgttaggaaccttaaacgtttacttaaccgttaggtaacctagttaccgaaagttaacgtttaacctttaacctttaccgtagtaacggttcgtaaccttaccaacccggtttaccggaaccgtaacgggaactaaacggtacgtacgggtaagtaacgttaaaaccgg

SEQ ID NO: 172171 - DNA, 570 bp, Homo sapiens
  misc_feature: GYAE6OF02GXH7A.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccacctgccgggccagtcagagcgttggtagtagcttacactggtaccagcagaagccaggtcagtctccaaagctcctcatcaagtatcgcttcccagtccttctcacggggtcccctcgacggttcagtggcagtggatcgtgggacacgtatttccaccctcaacccatccaatacgcctagggaacgtctagaaacgtatcgctagacctaaactttagttaccgttgtactactcgaagtacgttactaccgtttaacctacgtaagtcgtactcctaccgttccggaccgaagggaccacgacgtaggacgtaacttaaacgactggtacgcgtagaccacctatcttcgtcttacc

SEQ ID NO: 172172 - DNA, 525 bp, Homo sapiens
  misc_feature: GYAE6OF02GS6KF.27.78.H01.1.454.CMB.1.raw
  modified_base (514)..(514): a, c, t, g, unknown or other
  misc_feature (514)..(514): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtggcagtggatcgtgggacacgatttcaccctcaccatcaatacgcctggaaacgctagaagtatgctgacaacttattactgtcatcagtagtactactttaccactaagtcgatcaccgttcggaccgaagggaccacggactaggagtaagttaaacgacgtgtggatcgacaccgtntctcgtcttac

SEQ ID NO: 172173 - DNA, 587 bp, Homo sapiens
  misc_feature: GYAE6OF02HQF8O.27.78.H01.1.454.CMB.1.raw
  modified_base (442)..(442): a, c, t, g, unknown or other
  misc_feature (442)..(442): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagacctttcagtctgtgactaccaaaggagaaagtcaccatcacctgccggccagtcagagcgttggtagtagcttacactggtaccagcagagccaggtcacgtctaccaagcctcctcatacaagtatgccttccagtcccttctcgtacggggttcccctacggtacgttcgagtcgcgaggtggactcgtcggacactatttaccaccctacacctatacaatacgccgtaggaacnctagaagatgtcctagacctaactttattacctgtacaactcgtaagtacgtttaaccttactttacctataagtcgtacttaccgtacccgttaccgacccgtaacgggaccaccggtacgttacgggactaacgttaaaccgg

SEQ ID NO: 172174 - DNA, 617 bp, Homo sapiens
  misc_feature: GYAE6OF02F0TDT.27.78.H01.1.454.CMB.1.raw
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatcgcttcccagtccttctcgagggtccccctcgaggttcagtggcagtggatctcgggacactatttccacccttcaccatcaaatcgctaggaanctagaagatgctgacaacttattacttgtctatccagtaacgttacttaaccttttacctacctaaagttcggaattacccgtacccgtttacggacccgtaaaacggggacctaacggtacgttacgggtaacgttaaacgttaaaaccggttaacgttacgggttacgggacgttacggtacctaaaccccgtacgtttccgtttaccggttaccttttaacccg

SEQ ID NO: 172175 - DNA, 570 bp, Homo sapiens
  misc_feature: GYAE6OF02IE4D0.27.78.H01.1.454.CMB.1.raw
  modified_base (374)..(374): a, c, t, g, unknown or other
  misc_feature (374)..(374): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaacgccaggtcagtctaccaaagctcctcatcaagtatgccttccagtccttctcgacggggtcccctgtaggtcagtgcngtggactcgtggacacgtatttccaccctacaccatacaatacgcctaggaacgcgtagaagactgactgactaacttattacgtgtacatcaagattaaccttactttaccacgtaagtcgtattaccctaaccctttaccggacccgaaggggtaaccaaccggtaacgtagggtaacgtaagttaaaacccgg

SEQ ID NO: 172176 - DNA, 580 bp, Homo sapiens
  misc_feature: GYAE6OF02FN82N.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcactgccggccagtcagagcgttggtagtagcttacactggtaccagcagaagccaggtcagtctaccaaagcctcctcatacaagtatcgccttcccagtcccttctcgacggggtcccctggacggttcagtcggcaggtggatcgtgggacactactttccaccctcaccatactaatacgcctaggaacgcgttagaagtatcgcgtcgactaacttattactcgtactatacgagtacgttacttacctttacctacgtaacgtcgtaacttccgtaccgtttccggaccgtaacgggacctaccggtaacgtacgggaacgttaacgtaaaccgg

SEQ ID NO: 172177 - DNA, 568 bp, Homo sapiens
  misc_feature: GYAE6OF02IF1Y7.27.78.H01.1.454.CMB.1.raw
  modified_base (146)..(146): a, c, t, g, unknown or other
  misc_feature (146)..(146): n is a, c, g, or t
  modified_base (248)..(248): a, c, t, g, unknown or other
  misc_feature (248)..(248): n is a, c, g, or t
  modified_base (413)..(413): a, c, t, g, unknown or other
  misc_feature (413)..(413): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtgactccaaaaggagaaaagtcaccatcacctgccgggcagtcagagcgttggtagtagccttanactggtaccagacagaagccaggtcagtctaccaagtcctctcatacaagtatcgccttcccagtccttctcgacggggtcccctggtacggttcagtcggcgtagtggtatcgtaggacctactatttcccacctcacactcaatcgcctaggagtctagaagntgctagtacctaacttattactgtacatacagtactacttacttaacctacaagtcaactcctaccgttcggacgtaaggaccacgtacgtggtaacgtaaagttaaaccgtagtggtacggacgtcgaccaaccgtacttcgtcgttaccttcg

SEQ ID NO: 172178 - DNA, 600 bp, Homo sapiens
  misc_feature: GYAE6OF02HIF3Q.27.78.H01.1.454.CMB.1.raw
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctgccggccagtcagagcgttggtagtagcttacactggtaccagcagaagccaggtcagtctaccaaagctcctcatcaagtatcgcttcccagtccttctcgacggggttcccctcggtaggttcaggtggctaggtggatcgtgggacacgtactttccaccctcaaccacttaccaatacggccctagggaacgctaggaaagtatgactgtacctaaactttattacgtattcaatcaatacgttaactactttaccctanaacgttnacgtactaccgttacggaccaagggaccacggacgtaggaagtaaacgtttaaacggaaccgttggttacgggaccttacggaaccctaaccgtacgttacgttacgttaccg

SEQ ID NO: 172179 - DNA, 658 bp, Homo sapiens
  misc_feature: GYAE6OF02H3DRO.27.78.H01.1.454.CMB.1.raw
  modified_base (249)..(249): a, c, t, g, unknown or other
  misc_feature (249)..(249): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcgccgggccagtcagagcgttggtagtagcttaacncgtggtaccagcagaagccaggtcagtctccaaagctcctcatcaagtatcggtccttcccgagttcccttccgtccgtaccgggggttccccctcggtacgggttccaggttcgggctaggtcgggaattcgtagggacaacgtatttccgaccctcaaccatacaatacgccgtaggaacgtcgtacgaaggtaactggctacgtactaaacttttacgtttaacttagttacacttacgaacgtacgtttaaccttaaccttttaacctacgtaaacgtgtaacttccgtaacccgttccgggacctaaacggggaccaacggtacgtacggtaacgtaacgtttaaaccgaacgttacggttaggtccgtacgtacaacccgtacttcgttacgttccttacccg

SEQ ID NO: 172180 - DNA, 967 bp, Homo sapiens
  misc_feature: GYAE6OF02FYET8.27.78.H01.1.454.CMB.1.raw
tcagagcgtcgtctcacgaccggtgctcgatttagtgtgagtagtttgggtttgggggatcttaaaagaaggttcgtttctcgtgggagtgtggcaatgaggctaaaactgacaaacgtcgaaggtcaggtaagatgtttgccatcgacaactctagttgggtttcctgccgtgtcttctcgggttccacgccctccacgggtgaattgtgctgacgtcagtcgtccagtactttcagtctgtagacctacaacggagtaaagttacaccactccaacctaggacccgggtacctaacgttacgagtacggtaccgttagggtaacgtaaacgtacgttaacgaccgtcggtaccctaggacgaacggtaacggccctaggtaccttaaggttcccgtaccgaaaacggtccgtaccgttacgtacgttacctaaggtacttcgtccttacccgtacggttaccgttccgttccggtacgggggttacccctacgggttacggttttccgaacggttcggtaccgtaacggtaggtaccgtacggtacggggaacccttacccgttaacttttaccccgaaccccgttccgtaaaccgtaaaccgtttacgtaaaacggttcccgggtaaccgtttaaggggttaaaaccgttccggtttaaacggtaaacgggtaacgtttaccggtaaccgtttaacggtaacccgttttaaaaccgttttttaaccgttttacccgtttacggtttaaccccgtttaaggttaacccggtaaagggttaaacccgtttaaaccgtttttaaccgtttaaccccgttaaccggtaaaacggttttaacccggtaaaccgttttacccgggttaaaccccggtttttaccgggaaccccggtaaaccggggttaacccctaaacgggttacccggttaacgggtttaaaccgttaaccggttttaaaaaccccggg

SEQ ID NO: 172181 - DNA, 736 bp, Homo sapiens
  misc_feature: GYAE6OF02HBF6S.27.78.H01.1.454.CMB.1.raw
tcagagcgtcgtctcacgaccggtgctcgatttagtgtgagtagtttggggtttggggatacttaaaagaggttctttctctgggatgtggcatgagacaaaaactgacaagtcaaggcaggaagatgttgccatcaacaactcattgggtttctgctgcttctgggttccagccctccgaggggtgtaaattgtgctgactcagtctccagtactttcagtctgtgacctaccgaaaaggagaaacgtccaaccaatccaccgtcggcccgggacctagtccagaggcgttggtagtagcttacactggtaaccagacaagaacgccgaggtcagtctaccaaagcctacctcatcaagtatcgccttccacgttccttctccgtaccggggttcccctaggtacggttcgaggtcggacgtaggtggtacttcggtacggggaacctaccgtacgtttacccaacccccttcgaaaccctaactaaccgaaacgttacgaccccggtaggtaaacggtccgtacggaaagtacgtcgtaccgttacggtaaccttaaaccttttaagtttaccttaggttacctaacttaccgaaagttaaccgtttaaccttaaccttttaaccgtacgtaacggttactaaccgttaaccgtaacccggtttaccgggaacccggtaaacggggtaaccgaaccggtaacggtacgggaaaccgttaaggttaaaacccggg

SEQ ID NO: 172182 - DNA, 550 bp, Homo sapiens
  misc_feature: GYAE6OF02GAPO5.27.78.H01.1.454.CMB.1.raw
  modified_base (197)..(197): a, c, t, g, unknown or other
  misc_feature (197)..(197): n is a, c, g, or t
  modified_base (522)..(522): a, c, t, g, unknown or other
  misc_feature (522)..(522): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccagtactttcagtctgtgactccaaaggnaaagtcacatcacctgccgggcagtcagagcgttggtagtagcttacactggtaccagcagaagccaggtcagtctccaagctcctcatcaagtatgccttcccacgtccttctcgacgggtcccctggacgttcgagtggcgagtggatcgtggacacgtactttccaccctcaaccactcaactacgccgtaggaacgctagaagtagtgctgactaacttattactgtacatcagacgtacttacttacctactacgtagtactactaccttcggaccgaacgggaccacgacgtggaacgtaataaacgtacgtgtacggngtacgacctactactcttacgtcttacc

SEQ ID NO: 172183 - DNA, 597 bp, Homo sapiens
  misc_feature: GYAE6OF02JCS07.27.78.H01.1.454.CMB.1.raw
  modified_base (405)..(405): a, c, t, g, unknown or other
  misc_feature (405)..(405): n is a, c, g, or t
  modified_base (472)..(472): a, c, t, g, unknown or other
  misc_feature (472)..(472): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatacaagtatgccttccagtccttctccacgggtcccctcgacggttcaggtgcaggtcgatcgtgggacacgtattccaccctcacctatacaactagccgtggaaacgtcaggtaaancgtcgctcgactaacttattaccgtgtacatctaagtacgtttaaccttactttacctataaacgtntaactcccgtaacctttaccgggaacccgtaaagggtaccacggacgttagggtaacgtaaactttaaaccgaacggttgtaccggtcgtacgaccctaacgtacgtccgttattcccgttaccg

SEQ ID NO: 172184 - DNA, 567 bp, Homo sapiens
  misc_feature: GYAE6OF02J2L4K.27.78.H01.1.454.CMB.1.raw
  modified_base (406)..(406): a, c, t, g, unknown or other
  misc_feature (406)..(406): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgcttcccagtccttctcgacggggtcccctcggagttcagtggcagtggatcgtggacactatttccaccctcacctatacaatacgaccgtaggaagtcgtagaaagntcgctacgactaacttattactgtactatcaagtactacttaactttacctagtaagtcgatccacccgttcggacccgaagggacacgtacgtaggtaacgtaagttaaaccgacgttggtacgcctaggaccctaacctcgttaccgtgttccttaccg

SEQ ID NO: 172185 - DNA, 585 bp, Homo sapiens
  misc_feature: GYAE6OF02FVORZ.27.78.H01.1.454.CMB.1.raw
  modified_base (412)..(412): a, c, t, g, unknown or other
  misc_feature (412)..(412): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcacggggttcccctcggacggttcagtggctaggtggatcgtgggacactatttccaccctcacccatacaatacgaccgtaggaacgcgtagaacgngtgctacgactaacttattactgtactagtcaagtacttaaccttactttacctaacgtagtacgtactaccgtaccgttcggaacccggtaagggaccgacgtacgtagggaacgtaaacttaaacggtaacgtggtacggcgtacgacctaccgtatcgttacgtccttac

SEQ ID NO: 172186 - DNA, 638 bp, Homo sapiens
  misc_feature: GYAE6OF02IRN30.27.78.H01.1.454.CMB.1.raw
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatccacctgccgggccagtcagagcgttggtagtagcttacactggtaccagcaagaacgccaggtcagtctaccaaagctcctcatacaagtatcgcttcccagtccttcgtcgcggggtcccctgacggttcaggtcgcgtagtggacttcgtggaactactaactttccacccgtacaccgatcaatacggcctaggagacgtagaagtactgcgtagaccttaacttattacttcgtactactagaacggtacttaactacctttacgacgttaagtcgtactaccgtaccgtttaccgggaccgtaaacgggacctaacggacgttaacgggtaacgtaacggtttaaaaaccggaccggttacggtaccgggttacgtaaccgtacctacccgttaacgtttcgttaccgttccgtttaacccgg

SEQ ID NO: 172187 - DNA, 649 bp, Homo sapiens
  misc_feature: GYAE6OF02HMNPE.27.78.H01.1.454.CMB.1.raw
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaaggagaaaagtcaaccatcacatgccgggccagtcagagcgttggtagtagcttacactggtaccagcagaagccaggtcagtctcaaagctcctcatcaagtatgccttcccagttccttctccgtaggggtcccctcggacggttcaggtggcaggtggatcgtgggacacgactttccaccctccaccatacaatagcctaggaanctagaagntgctcgactaaacttattaacttgtactatacaagtaacgttaacctttaaccgtttaacccttacgtaaagttcgaactttcctaacccgtttaccgggacccgtaaacggggtacccaacgggtaccgttaacggggtaaacgttaaaccgtttaaaaaccggtaaccggtttaacgggttacggtaccggtttaccgaacccgtaacccgtacgtttacccgttacgtttaccccg

SEQ ID NO: 172188 - DNA, 703 bp, Homo sapiens
  misc_feature: GYAE6OF02ITQG2.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagtcgttggtagtacgcttacactcggtaccagcagaagccaggtcagtctaccaaagctcctacattaccgaagtatcgtccttccgacgtcccttctaccggtaccggggttcccctacggtacggttacacggttggacaggtaggtactcgtacgggtaactacgtacgtttacccacccgttcctaaccacttaacgaacgtaaccggtaccgtacggtaaacgtcgttaacgaaaggtaacgttcggaccgtaggtaacctaaaacttttaacgttaccgttagttaccgtaacgttaacaacgttaaacggtttaaccctttaacccggttttaacccttaaccgtaaacggttgtaacccttacgtaaccccgttaccgggtaacccgtaaacgggaccctaacggacgtaaggtaaccgttaaactaacggtaacttggtacgctcgaccactactctacgttcc

SEQ ID NO: 172189 - DNA, 594 bp, Homo sapiens
  misc_feature: GYAE6OF02JHGLH.27.78.H01.1.454.CMB.1.raw
  modified_base (288)..(288): a, c, t, g, unknown or other
  misc_feature (288)..(288): n is a, c, g, or t
  modified_base (529)..(529): a, c, t, g, unknown or other
  misc_feature (529)..(529): n is a, c, g, or t
tcagagcgtcgtctcacgaccggtgctcgatttagtgtgagtagtttgggtttgggggtcggatgagcaaaactagacaagtacaaggcaggaagatgttgccatcacaactcattggtttctgctgctctgggttccagcctccaggggtgaaattgtgctgactcagtctccagactttcagtctgtgactccaaagagaatcaccatcacctgccggccagtcagagcgttggatgcttacactggtaccagcagaagccaggtcagtctaccaaagccttaccncatcaagtatgccttcccagttccttctcgacggggtccccctgaggttcaggtggcagtgggactctacggggacacctattttccacccccttacacccgtattccaaattccgaccgtaggacgtcaggtaaagagttgctacgtacctaacgttatttacctcgttcatcaagtacgttaaccttactttacctactaaggtacacgttacctacccgttcgtaacgaacggtaccngtaacgtggacgtaattaacggaactaggttccgcgttaccgctaaccgtacttactcgttaacc

SEQ ID NO: 172190 - DNA, 540 bp, Homo sapiens
  misc_feature: GYAE6OF02I4UFC.27.78.H01.1.454.CMB.1.raw
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggagtagcttacactggtaccagcagaagccaggtcagtctccaaagctcctcatacaagtatcgtcttcccagtccttcctcgtaccggggtcccctcgaggttcagtcggcacgtggatcgtggacactactttccaccctcaccatcaatacgccgtgaacgctagaagancgctgactaacttactactcgtcatcagtactaccttacttacctcgtaagtntactcgtaccgttccgacgaacggacacgtacgaggacgtataaacgg

SEQ ID NO: 172191 - DNA, 520 bp, Homo sapiens
  misc_feature: GYAE6OF02FXHM4.27.78.H01.1.454.CMB.1.raw
  modified_base (446)..(446): a, c, t, g, unknown or other
  misc_feature (446)..(446): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatcgtggacactatttccaccctcaccatcaatacgcctaggaagctagaagatgctgactaacttattactgtcatcagtagtacttactttaccacagtnactcaccgttcgacgaaggacacgtacgtaggagtaacttaaacgactgtagactgacctaccatctgtcttac

SEQ ID NO: 172192 - DNA, 499 bp, Homo sapiens
  misc_feature: GYAE6OF02IU339.27.78.H01.1.454.CMB.1.raw
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
tcagagcgtcgtctcacgaccggtgctcgatttagtgtgagtagtttgggtttggggatgagcaaaactgacaagtcaaggcaggaagatgttgccatcacaactcattggggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcagggtcccctgaggttcagtgcagtggatctgggacacatttcacctcaccataccaatagcctggaacgctagaagatgctcgactaacttattacttgtacattcagtagtacttacttacctcaagtnatcaccttcgcaaggacacgatggagataaacgacgtgtgnagcacatctcgtntc

SEQ ID NO: 172193 - DNA, 572 bp, Homo sapiens
  misc_feature: GYAE6OF02ITQLM.27.78.H01.1.454.CMB.1.raw
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (423)..(423): a, c, t, g, unknown or other
  misc_feature (423)..(423): n is a, c, g, or t
tcagagcgtcgtctcacgaccggtgctcgatttagtgtgagtagtttgggtttggggatcttaaaagaggttctttctctgggatgtggcatgagcaaaactaacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggtagtagcttacactggtaccagcagaacgccaggtcagtctccaaagctctcatcaagtngcttccatcctncacgggtccctgagttcagtgcagtggatcgtgggactacacgtttccacccttcacctatcaaactagcctaggaagtctagaanatgctcgactaacttattactgtaccattacgagtaacgttacttacctttacctacgaagttcgtaactacccgtaccgtttacccggaccgtaaacggggtaccaaccggttaaccgtagggtaacgtaacgttaaaccgtaaccgg

SEQ ID NO: 172194 - DNA, 668 bp, Homo sapiens
  misc_feature: GYAE6OF02ITPRK.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtgaaattgtgctgactcagtctccagactttcagtctgtgactccaaagganaaagtcaccatcacctgcgggccagtcagagcggttggtagtacgctacacgtggtaccagcagacgccaggtcagtctaccaaagctacctcatacaagtatgccttcccagtccttacctcgacggggtcccctcgacggttcagtggctagtggactcgtcgggacacgtactttacaccctaccacctactacctaaacgtacgaccgtgggaacgtacgtacggtaaacggagttggccttacggaccttaaaaccttttacgtttaaccgttacggttacttaacgttaccgtaaagtaccgttaactttaacctttaacccgttaactaagttacgtaccttcctaacccggtttaccggaacccggtaaacgggaccaaccgggtacgtagggtaaacgtaaacgtttaaaccggacgttaggtacgttcgacgtaccgacctaattccgttacgttcttacccg

SEQ ID NO: 172195 - DNA, 532 bp, Homo sapiens
  misc_feature: GYAE6OF02G1YK2.27.78.H01.1.454.CMB.1.raw
  modified_base (195)..(195): a, c, t, g, unknown or other
  misc_feature (195)..(195): n is a, c, g, or t
  modified_base (398)..(398): a, c, t, g, unknown or other
  misc_feature (398)..(398): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggcagtcagagcgttggagtagcttacactggtaccagcagaagccaggtcagtctccaaagctcctcatcaagtatgcttcccagtccttctcagggtcccctgaggttcagtgcagtgatctggacacatttcaccctcaccatcaatacgcctggaagctagaagatgctgctaacttnttactgtcatcagtactactacttacctatagtgactcaccttcggaccaaagggcacggtactagggaacgtaacgtttaaacgaacgttggtacggtactacggacctacctattccgttcgtaccttaccg

SEQ ID NO: 172196 - DNA, 654 bp, Homo sapiens
  misc_feature: GYAE6OF02H3MJM.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtgactcgaaaggagaaagtcacatcacctggccggccagtcagagtcggttaggtacgtagcttacacgtggtaccagcagaagcccaggtcagtctccaaaagcctccgtcactcaagtatgtcttcccagttccttcctcgtacggggttcccctcggtacggttcaggttcggccgaggttgggactcgttaggggactaacacgttttccacccctacacccgtacttaccaaacttacggacccttagggaaacgtctaggtaaacggtatgcgtcgacctaaatttactttaactgttacaattcaagtacgttaactttaacttttaaccctactaacgtagtactaccgtacccgtttaccggaccggtaaacgggaccgtacgtacgtacgggaacgtaaaggttaaaccggacgtaggtacggacttacggccctaaccgtactcgttcgttactttaccg

SEQ ID NO: 172197 - DNA, 554 bp, Homo sapiens
  misc_feature: GYAE6OF02G6ALB.27.78.H01.1.454.CMB.1.raw
  modified_base (195)..(195): a, c, t, g, unknown or other
  misc_feature (195)..(195): n is a, c, g, or t
  modified_base (416)..(416): a, c, t, g, unknown or other
  misc_feature (416)..(416): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctaccgggccagtcagagcgttggtagtagcttacactggtaccagcagaagccaggtcagtctccaaagctcctcatcaagtatgcttccagtccttctcacggggtcccctcgaggttcagtggcagtggatcgtgggacactatttcaccctcaccatcaatacgcctaggaagctaggaagatgctgactaacttactactnttacatcagtagtaccttaacttttacctctaagtcgtatccaacctttcgggacccaaagggacacgacgtgggaagtaacgttaaacgaacttcggtaggtctaggacctaacctatacttcgttccttacgtacc

SEQ ID NO: 172198 - DNA, 524 bp, Homo sapiens
  misc_feature: GYAE6OF02G479G.27.78.H01.1.454.CMB.1.raw
  modified_base (228)..(228): a, c, t, g, unknown or other
  misc_feature (228)..(228): n is a, c, g, or t
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtcctctcaggggtcccctcgaggttcagtggcagtggatctggggacacattttcacccctcaccatcaatagcctggaagctgaagatgctgcaactttntactgtcattcagagttactactttacctctaaggtcgattcaccttcggcctaaggggccaacggacctgggacgattaaaccgg

SEQ ID NO: 172199 - DNA, 618 bp, Homo sapiens
  misc_feature: GYAE6OF02HX2TO.27.78.H01.1.454.CMB.1.raw
  modified_base (180)..(180): a, c, t, g, unknown or other
  misc_feature (180)..(180): n is a, c, g, or t
  modified_base (230)..(230): a, c, t, g, unknown or other
  misc_feature (230)..(230): n is a, c, g, or t
  modified_base (296)..(296): a, c, t, g, unknown or other
  misc_feature (296)..(296): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccggccagtcagagcgttggtagtagcttacactgtaccagacagaacnccgaggtcagtctaccaaagcctcctcactacaagtatcgccttcccgagttcccttctaccggtacggggttcccctcggtacggttacgaggtggcgtaggtggtactcgtacgggacaccgtatttcccaccctcaaccctatacgaattacgcgtacggaagtcgaagaagtatcgtactagaacctaactttacttacgttactactactacgtaagtaacgttaaccttaccttttaccacttaacggtctaccttaccgtaccggttaccggaccgtaacggaccaacggtacgtacggtagtaacttaaaccgg

SEQ ID NO: 172200 - DNA, 549 bp, Homo sapiens
  misc_feature: GYAE6OF02F32AR.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagctcctcatcaagtatgccttcccagtccttctcgacgggtcccctgaggttcagtgcagtgatcgtggacactctttcaccctcaccatacaatacgctacggaagctagaagatgctcgactaacgttattacgtgtctagtccagtacgtacttaccgtttacacgtactgtaactcgtaccgtttcgaccgaggaccacgacgtaggacgtaacgttaaacgacgttggtagtcgtacgtcaccgtatccgttacgtctttaccg

SEQ ID NO: 172201 - DNA, 627 bp, Homo sapiens
  misc_feature: GYAE6OF02HRQ5J.27.78.H01.1.454.CMB.1.raw
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaaggagaagtccaccatccacctggccgggccagtcagagcgttggtagtagcttacncgtggtaccagcagaagccaggtcagtctccaaagctcctcatcaagttntacgtccttcccagtcccttctcgtacggggtcccctgtaggttcaggtggcgagtggatcgtgggacacgtatttccgaccctcaccatcaaatacgcctagggaactctaggaatagttcgctacggacctaaactttacttaacgtcgtacattaccaaggtaacttaccgttactttaaccgtactaagttcgaacttcctaaccgtttaccggaaccaagggtaccacggtacgtacggaagtaacgttaaaaccgacggttacggtacggtaccgtcgaaccctaaccgttatacccgttacgttaccctttaacccg

SEQ ID NO: 172202 - DNA, 544 bp, Homo sapiens
  misc_feature: GYAE6OF02GTWBW.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcggaggttcagtggcaggtggatcgtgggacactatttccaccctcaccatcaatacgcctaggaagtctagaagatgctgactaacttattacgtgtcatcagtacgttacttacttacctagaagtctaactcctaaccgttccggaccgaacggaccaacgacgtaggtagtaattaaacgg

SEQ ID NO: 172203 - DNA, 536 bp, Homo sapiens
  misc_feature: GYAE6OF02FX0W0.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctgaggttcagtggcagtggatcgtgggacacatttcaccctcaccatcaatacgcctaggaagctagaagatgctgctaacttattactgtcatcagtagtacttacttacctacaagtgacttcctaccgttcggaccgaacgggaccacgacgtaggaagtaacttaaacggacttagtcggacttcgacctacctacttctagttacc

SEQ ID NO: 172204 - DNA, 586 bp, Homo sapiens
  misc_feature: GYAE6OF02HM7HO.27.78.H01.1.454.CMB.1.raw
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
  modified_base (461)..(461): a, c, t, g, unknown or other
  misc_feature (461)..(461): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggttcccctcgtaggttcagtggcaggtgatcgtgggacactntttcaccctcacctatcaatacgcctaggagctagaanatgacgtgactaacttattactgtactatcgagtacgttacttacctttacctactaagttnacttcctacccgtttcggaccgtaagggacctaccggtacgtacgggtaacgtaaacgtttaaaccgtaaacgttcggttacggaccgttacggaccctaaccgtacttccgttacgtttacccg

SEQ ID NO: 172205 - DNA, 585 bp, Homo sapiens
  misc_feature: GYAE6OF02I1KGF.27.78.H01.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccggccagtcagngcgttggatgcttacactggtaccagcagaagccaggtcagtctccaaagctcctcatcaagtatgcttccagtccttctcacggggtcccctcggtagttcagtggcaggtgatcgtgggacacgactttcaccctcaccatacaatacgcctggaacgtcctagaagatgctagcctaacttattaccttgtactactctaacgagttaccttactttaaccctacgtaacgttacgacttacctaccctttccgggaccaaaggggaccaacggtacctgggtaacgtaacgttaaacgacttacgggtagtcccgttagccctaaccgtactttccgttacggttcctttacccg

SEQ ID NO: 172206 - DNA, 628 bp, Homo sapiens
  misc_feature: GYAE6OF02HF414.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggcagtcagagcgttggtagtagcttacactggtaccagcaagaacgccaggtcagtctaccaaagcctcctcatcaagtatcgcttcccagtcctctcgacgggtccctgacggttcagtggcagtggatcgtaggactacgtactttccgaccctacacccatacaaatcgacctaggaacgtcgtaggaagtatgacgtgacttaacgtttaattacgttcgtaccaatacgaaacgtacgtaacctttaaccgtttaaccctactaaaggttcgtaacttacccgtaccgtttccggaaccggaaacggaaccgtaccgacggtttacggaacgtaaaacttaacccggtaagttcggagtttaccgcgtacccgtaaccacgtttaccgtcgtttaccgttaaccc

SEQ ID NO: 172207 - DNA, 563 bp, Homo sapiens
  misc_feature: GYAE6OF02HCYKW.27.78.H01.1.454.CMB.1.raw
  modified_base (318)..(318): a, c, t, g, unknown or other
  misc_feature (318)..(318): n is a, c, g, or t
  modified_base (427)..(427): a, c, t, g, unknown or other
  misc_feature (427)..(427): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccaggtcagtctcaaagctcctnatcaagtatgcttcccagtcctctcgacggggtcccctcgacggttcagtcggctagtcggatcgtagggacactatttccaccctcacctatacaatacgcctggaanctagaagatgctgactaacttattactgtacactcaagtacgttaccttactttacctactaagtcgaacttccaaccgtttaccggaccgtaacgggacctaacggtaccgtacggtacgtaaagttaaaaccgg

SEQ ID NO: 172208 - DNA, 755 bp, Homo sapiens
  misc_feature: GYAE6OF02JYXNP.27.78.H01.1.454.CMB.1.raw
  modified_base (185)..(185): a, c, t, g, unknown or other
  misc_feature (185)..(185): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (442)..(442): a, c, t, g, unknown or other
  misc_feature (442)..(442): n is a, c, g, or t
tcagagcgtcgtctcacgaccggtgctcgatttagtgtgagtagtttgggtttggggtagtgagcaaactagacaagtcaagcaggaagatgttgccatcacaactcattgggtttctgctgctctgggttccacgcctccgagggtgaaattgtgctgactcagtctccagactttcatctgtnactccaaaggagaagtccaccataccaccgtggcccgggactaggtaccaaggagcgttgggttagtaacgctttacgaacctggtacccagcaagaagccgagttcgatcgtaccaaagtctcctactacactaacgtntacnccttcccagttccctttccgtacggtacggggtcccccttacgagggttttaccacggttcggcacggtttggactcggtacgggaacctactaacgttttcccaaccccttnaaacccggttataaccgaaatttcggccgttacggaggtacgtagtaacgctagcccttagaaccttaaaccgttatttaaccgcgtttactaacgaccgttaagaaccctttaatttacccgttttaaccgtacttaacgtacgttaccttaacccgtttaacccgttacccggggaaacccgttaaagggaacccgttaacggacccgttaagggtaaacgtaaacggttttaaacccgaaggtttacccgtggtaacccgttaccgtacgtaaccccgttaagtttccccgtaacggttttcccctaagg

SEQ ID NO: 172209 - DNA, 588 bp, Homo sapiens
  misc_feature: GYAE6OF02F0WS1.27.78.H01.1.454.CMB.1.raw
  modified_base (149)..(149): a, c, t, g, unknown or other
  misc_feature (149)..(149): n is a, c, g, or t
  modified_base (311)..(311): a, c, t, g, unknown or other
  misc_feature (311)..(311): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgctccagtccttcncagggtcccctgaggttcagtggcagtggactcgtgggacactacttccaccctcaccatccaaatcgaccgtaggaacgtccgtaggaaagatgcctaggcctaaactttacttacttaggtaccaattacaggtacgttaaccttaacctttacctactaagttacgacttccgaaccctttcggaacccgtaacgggaccaccggtacgtacggtaacgtaacttaaacggaacttgtacggtctacgaccacccgtattaccgtagtttaccc

SEQ ID NO: 172210 - DNA, 552 bp, Homo sapiens
  misc_feature: GYAE6OF02FPAWO.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcactcaagtatgccttcccagttccttctcgacggggtcccctcggaggttcagtggcaggtggatcgtgggacacgtatttccaccccttcaccatacaaatacgaccctaggaacgtcttagaacgatgactgactaacttattactgtctactcagtacgtaccttactttaccactaagtcgactcctaccgttcggaccaagggaccacgtactaggacgtataaacgg

SEQ ID NO: 172211 - DNA, 610 bp, Homo sapiens
  misc_feature: GYAE6OF02F87FN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttcgtccgacggggttcccctcggtacggttcagttggcaggtggatcgtgggacactactttccaccctcaccatacaatacgccttaggaacgctagaaagtacgtgctagacctaaactttattacgtgtactaatacgagtaacgttaccttactttaacctacgtaaacgtgtaactacctaaccgtttccgacccgtaaagggacctaaccgtacgtaggaaacggtaacttaaaacggtacgttacggacggtccgtacggacctaacccgtattccgttacgttaccctttaccg

SEQ ID NO: 172212 - DNA, 750 bp, Homo sapiens
  misc_feature: GYAE6OF02GJ7OF.27.78.H01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaagganaaagtcaccatcacctcgccggccagtcagagcggttggtagtagtcttacactggtaccagcagaagccaggtcagtcaccaaagcctcctcatacaagttatcgtccttcccgtacgttccttcctcgtaccggggtccccttaggacggtttcaggttcggacgtaggtcggtacgtcggtacggggtacctaacgttacttttaccccgaacccccttaccaaccctaacgtaccaaacgttaccggacccgttaaggggtaaacgtaccgttaaggaaacggtagtacggtaccgtacggttaccttaaaaccgtttttattaaccgttacgttaccgtaaacttaccgtaaacgttaaaccgtttaaccctttaacccgtttttaaccctaacggttaaacggttaacggtaaccctttacccggtaacccgttttaacccgggaacccggtaaacggggaccctaaaccgggtaaccgttagggtaaaccgttaacggttaaaaacccggg

SEQ ID NO: 172213 - DNA, 565 bp, Homo sapiens
  misc_feature: GYAE6OF02FUZ9C.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatcgcttcccagtcctttctcgacgggtcccctcggaggttcagtcggcagtgatcgtggacactactttccaccctcaccatacaatacgcctaggaacgtcgtagaagtatagctacgactaacttacttacttcgtactagtacagtagttacctttaactttacctactaacgttgtaacttaccgtaccttccggaccgtaagggacaccggtacgtagaagtaataacgtacgtcggtagcgtacgacctacactctagtcttac

SEQ ID NO: 172214 - DNA, 532 bp, Homo sapiens
  misc_feature: GYAE6OF02F1SQ5.27.78.H01.1.454.CMB.1.raw
  modified_base (521)..(521): a, c, t, g, unknown or other
  misc_feature (521)..(521): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacacgtatttcaccctcacccatacaatacgcctagggaacgctaggaagtatgctagactaacttacttaactgtacatcagtagtaccttacgtttaccactaagtcactcaccgttcgaccgaaggacacgactaggagtaacttaacgactgtggactcgccactntctcgtcttac

SEQ ID NO: 172215 - DNA, 670 bp, Homo sapiens
  misc_feature: GYAE6OF02HYLCU.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagacagaagccaggtcagtctaccaaagcctcctcatacaagttatcgtccttccccagttcccttcgtcgaccgggtcccctcgtacggttcaggtggcgtagtggatcgtgggactactacttttaccacccctacaaccctataccaagtacgtaccgtagggaacgcgttagaaagagtagtacgtgtaacctaacgtttaattacttacgtactacgtacgtaagttacgttaacctttaccttttacccgttaacgtaacgttacgtaacttacccgttaacccgtttaccgggaacccgtaaacggggtaccctaccggtacgtaagggtaacgtaaacgtttaaaaccggacgtcggttacggtaccgtacggtacccaccgtaccgttcttccgttactttacccg

SEQ ID NO: 172216 - DNA, 616 bp, Homo sapiens
  misc_feature: GYAE6OF02GYDBA.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcgacggggtcccctggacggttcaggtcggctagtggtatcgtcgggacacgtactttccaccctcaccctatacctaatacgacccgtagggaacgtactaggaaacgtagtacgcgtagaaccttaacttactttacttcgtacacttacgaacgtacgttaaccttactttaacccttacgtaagttcgtaattacccgtaccgttcggaccgaaagggaccgacgtacgtaggaacgtaacgttaaaacggtacttaaggtcggtacgtacgccgactacgttcgttcgtctttacccg

SEQ ID NO: 172217 - DNA, 576 bp, Homo sapiens
  misc_feature: GYAE6OF02G9QQJ.27.78.H01.1.454.CMB.1.raw
  modified_base (301)..(301): a, c, t, g, unknown or other
  misc_feature (301)..(301): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccaggtcagagcgttggtagtagcttaacactggtaccagcagaagccaggtcagtctccaaagctcctcatcaaaaaagtntgcttcccagtccttctcgacgggtcccctgacggttcagtggcagtggatcgtgggacactactttcaccctcaaccatacaactacgcctaggaacgtctagaaacgtatcggctagactaacttattacttgtacatacagacgttacttacttacctactaagtacactactaccgttcgacctaaagggcaaccgtacgtaggaacgtaagttaaaccgtacgtacgttaggtacctcgtaccaaccgtacgttacgtacgttccttacg

SEQ ID NO: 172218 - DNA, 674 bp, Homo sapiens
  misc_feature: GYAE6OF02H2JOC.27.78.H01.1.454.CMB.1.raw
  modified_base (150)..(150): a, c, t, g, unknown or other
  misc_feature (150)..(150): n is a, c, g, or t
  modified_base (180)..(180): a, c, t, g, unknown or other
  misc_feature (180)..(180): n is a, c, g, or t
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctccgaggggtnaaattgtgctgactcagtcctcagactttcagtctgtgactccgaaaagganaaacgtcaaccatcacccgtggccgggccagtcagagtcggttggtagtagcttacactggtaccagacagaacgccaggtcagtactccaaagcctacctcactacaagtactcgccttccacgtccttacgtcgtaccggggttcccctcggtacggttcctaggtacggctaggttacggtagttccggtagggactaccgtactttcccgaaccctccaacctactaactaactacggtaccgtaggaacgtcgtacgaaagtatacggtctagtacctaaactttacttacgttcgtacctacgttaccgaagttaacgtttaacccttaacttttacccgtacgttaaaggtcttaacgttaccgtacccgttaacccggtccgaaacggggtaaccctaacggtacccggtaaggtacgtaacgttaaaaccggg

SEQ ID NO: 172219 - DNA, 720 bp, Homo sapiens
  misc_feature: GYAE6OF02G32W9.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggcagtcagagcgttggtagtagcttacacgtggtaccagcagaacgccaggtcagtctaccaaagtcctcctacatcaagttctcgccttcccacgttccctttctccgtacgggttcccctacggtacggtttcaggtcggactaggtggaacttcgtacgggactaccgtactttaccaaccccgttcaaccctaattaccaaattaccggaccgttaagggaacggtacgtaaggaaagtacgtcgacgttacggtaacccttaaaccgtttaatttaacccgttgttaacctaacgttaccgtaagttaaccgtttaacctttaaacccgtttttaaccgtaacgtaaacgttacggtaaccttaccgtaaccccgtttacgggaacccgtaaacggggtacctacggtaacggttacgggtaaacgttaaaccgtttaaaacggaacgttcggtacggtacgtcggaacctaaccgtactttccgttacgtttaccc

SEQ ID NO: 172220 - DNA, 515 bp, Homo sapiens
  misc_feature: GYAE6OF02FLON1.27.78.H01.1.454.CMB.1.raw
  modified_base (195)..(195): a, c, t, g, unknown or other
  misc_feature (195)..(195): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (505)..(505): a, c, t, g, unknown or other
  misc_feature (505)..(505): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccggccagtcagagcgttggtagtagcttacactggtaccagcagagccaggtcagtctcaaagctcctcatacaagtatgccttcccagtccttctcgacggggtcccctcgagttcagtgctagtggatcgtgggacacgtacttccaccctcacctatcaatacgcctggaacgtctagaagatgctagactaacttacttactgtacatcagtacgtactactttaccanagtnactctaccgtcgacaacgcacgacgtgacgtaataacgactgcgctacgcaacntctgtctacg

SEQ ID NO: 172221 - DNA, 665 bp, Homo sapiens
  misc_feature: GYAE6OF02H7H80.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtgaaattgtgctgactcagtctccagactttcagtctgtgactccaaaaggngaaagtcaccatcacctgccgggcagtcagagtcgttggtagtagcttacactggtaccagcagaagccaggtcagtctccaaagctcctcatcaagtatgccttcccagttcccttcgtccgtacggggttcccctcggtacggttcagtggcaggtggtactcgtacgggtacacctacttttcccacccctcaaccctaatctaaactacgtacccttagggaagtcctaggaaagtacgtacgtcttacggtaacttaaacttttacgtttaactcggttactaacgtactaaacggtaaccgttaaccttaacctttttaaccctacgttaaacgttcgtaacgtttacccgtaacccgtttaacccgggacccgaaacggggtaaccctaccggtaaccgtaacggggtaacgtaacgtttaaaaacccgg

SEQ ID NO: 172222 - DNA, 1021 bp, Homo sapiens
  misc_feature: GYAE6OF02FKSA5.27.78.H01.1.454.CMB.1.raw
tcagagcgtcgtctcacgaccggtgctcgatttagtgtgagtagtttgggtttggggatgagcaaactgacaagtcaaggcaggaagatgttgccatcacaactcattggttctgctgctctggttccagcctccgaggtgaattgtgctgactcagtctccagtacttacagtcctgtcgaacctaccgaaaggacgaaacgtccaccactccacccgtcgcccgggccagtccgaggacgtcgtggtacgtacgtcttaccacgtacggtaccagcaagacgtccgacgggtcctacggtccctaacccgaaacgtcccttcccctacacgttaccgaaacgttcgtcgtaccgtttacccgtaccggtttacccgttccggttacccggtacccggggttacccccgttacgggtaccggtttaccggaaggtccgggttaacgacgggtttacggtaccgttaccgggtaacgggtaacccctaacccgtttaacccgtttacccccaacccccggttaacctaaaccccgtacgttaacccgtaaacgtacccggtacccggttaaacgggtaacccgtaccgttaaacggtaaaccgtaccgtttaccgggtacccttaacccgggttaaacccttaacccgtttttaacgttaccccggtttacttaacccgttaaaccgttaacccgtaaaccggtttaaccccggttttaaccccctttaaaacccggtttaacccccgtaaaggtttaaacccggtaacccgtttaaacccggttaaaccccccggttttaccccgggggaaaaccccgtaaaccccggggtaaaacgggtttacccccgaaaaaccgggttttaccgggtaaacccgggttaaaaccggttttaaaaacccggttaacccgggttaaacccggtttacgggttaccccggaacccgtttacccggtaaccccgttaaaccccggtttctacccccgggtttaccgttttacccccgtttaaaccccccgg

SEQ ID NO: 172223 - DNA, 619 bp, Homo sapiens
  misc_feature: GYAE6OF02G1IV2.27.78.H01.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (611)..(611): a, c, t, g, unknown or other
  misc_feature (611)..(611): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtntgcttcccagtccttctcacggggtcccctggtacgttcagtggcagtggactcgtgggacacgtactttccacccgtcaccctataccaaatacgtacccgtgggaacgcttaggaaagtagtgcgtacggtactaaactttactttaacttcgtactatcaacgtacgttacctttaacctttaaccctacgaaacgttacgtaacttacctacccgtttaccgggaccgtaaacgggaccgaaccgtacgtacggtaggtaaacgttaaaccgaacgttaggttcgacgtcgaccgacctacgttcgttaccgtntttacccg

SEQ ID NO: 172224 - DNA, 559 bp, Homo sapiens
  misc_feature: GYAE6OF02FJVD7.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagtcttacactggtaccagcagaagccaggtcagtctccaaagtctcctcatcaagtatcgcttcccagttcccttctcgtacggggtcccctgtacggttcagtggcaggtcggatcgtggggactactacttttccaccctcaccatacaatcgctaggaactctagaacgatgctgactaacttattactgtacatcaagtagttaccttactttaccactaaggtcaacttccaccgtttcggaccaacgggacctaacggtacgtacggacgtaataaaccgg

SEQ ID NO: 172225 - DNA, 555 bp, Homo sapiens
  misc_feature: GYAE6OF02FTL39.27.78.H01.1.454.CMB.1.raw
  modified_base (230)..(230): a, c, t, g, unknown or other
  misc_feature (230)..(230): n is a, c, g, or t
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
tcagagcgtcgtctcacgaccggtgctcgatttagtgtgagtagtttgggtttggggatcttaaaagaggttctttctctgggatgtgacatgagcaaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatccacctggccgggccagtcagagcgttggtagtagcttacactggtaccagcagaagccaggtcagtcctaccaaagcctcctcatcaagtatcgcttcccagttcccttctcgacggggtcccctggacggttcagtggcaggtgagtcgtgggacactctttccaccctcacctatacaatacgcctaggaacncgtagaagtatgactgacctaacttagtactgtacagtcagtattacctactttaccatacggtnacttccaccgttccggaccgaacgggacaccgtagtacggagtaataaaccgg

SEQ ID NO: 172226 - DNA, 593 bp, Homo sapiens
  misc_feature: GYAE6OF02GN2ID.27.78.H01.1.454.CMB.1.raw
  modified_base (337)..(337): a, c, t, g, unknown or other
  misc_feature (337)..(337): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagttctgtcgacctccgaaaaggagaaacgtcaccatccacctgccgggccagtcagagcgttggtagtagcttacactggtaccagcagaagccaggtcagtctccaaagctcctcatcaagtangccttcccacgttcccttctcgacggggttcccctcggacggttcagtggcaggtggactcgtgggactacgtatttccaacccttcgaacctactacaactacgccgtaggaaagtctagaagtagtgacgtacgactaaactttattacgtacgtctactcgagtaacgttaccttactttacctactaagtcgaattccctaaccgttccgggacctaacgggacaaccgtagtacggtagtaacttaaacgg

SEQ ID NO: 172227 - DNA, 694 bp, Homo sapiens
  misc_feature: GYAE6OF02IBLPB.27.78.H01.1.454.CMB.1.raw
  modified_base (146)..(146): a, c, t, g, unknown or other
  misc_feature (146)..(146): n is a, c, g, or t
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggagtagcttacnctggtaccagcagaagccaggtcagtctcaaagctcctcatcaagtatgcttccatcctctcacgggtccctgtaggttcagtggcagtggattcgngggacactatttccgacccttcacctataccaattacggccttagggaaacgtccgttaggaaacgtagttacgacttacgtacctaaacgttttaactttaaccgttaggttacctaaacgttccgtaaggtaacggtttaaacctttaaccctttttaaccctaacgttaaacgttacgttaacttaccgttaacccgtttacccgggaaccgtaaaacggggaccctaaccggtaaccgttaacggggtaaacgtaaacggtttaaaaccggtaacgttacggttaccgggtaccgttacggtacccgtaacccgttaacgtttcgtttacgttacccgtttaaccccg

SEQ ID NO: 172228 - DNA, 529 bp, Homo sapiens
  misc_feature: GYAE6OF02F6FY3.27.78.H01.1.454.CMB.1.raw
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccggccagtcagagcgttggtagtagcttacactggtaccagcagaagccaggtcagtctccaaagctcctcatcaagtatgcttcccagtccttctcacgggtccctcgcggttcagtgcagtggatcgtgggacactatttcacccgtcaccatcaatacgcctggaagctagaantcgctgactaacttatacttgtactatacagtatactacttactcaagttnaatcctaccttacggaccgaaggtaccgacgtacgtacggagtaattaaaccgg

SEQ ID NO: 172229 - DNA, 694 bp, Homo sapiens
  misc_feature: GYAE6OF02I246N.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggccagtcagagcgttggtagtagcttacactggtaccagcagaagccaggtcagtctaccaaagcctcctcatcaagtatcgtccttacccagtcccttctaccgtacggggtccccctcggtaggttcaggtggcgtaggtggatcgtggggacctacgtactttaccaccccgttacaacccgtaattacccaaacgttacggtcccgtaacgggtaaacggtccgttaaggaaagtagttacggccttacgtaaccgtaaaaccttttactttaacgtgttaccgaacttcgtaaagtacgtttaacctttaaccgtttaacccttaacgtaacgttacgacttacccgttaaccgttccggaaacccgtaaggggtaccaccggtacgttagggaaccggttaaagttaaacccgggaagttacgggtacggtaccggtacgtacccgacctacggttaccttggttacccg

SEQ ID NO: 172230 - DNA, 576 bp, Homo sapiens
  misc_feature: GYAE6OF02FZXR5.27.78.H01.1.454.CMB.1.raw
  modified_base (179)..(179): a, c, t, g, unknown or other
  misc_feature (179)..(179): n is a, c, g, or t
  modified_base (461)..(461): a, c, t, g, unknown or other
  misc_feature (461)..(461): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagtcttacactggtaccagcagaagccaggtcagtctaccaaagctcctacatcaagttatcgtccttcccacgttccttctccgacggggttcccctacggtacggtttcagttggctaggtggactcgtcgggacactactttccaccctcaccatacaatacgcctaggaacgctagaagatgactnacctaacttacttactgtactactcagtacgttacttacctttaccgtactaaggtnaacttccgtaccgtttcggacgtaacgggacaacggacgtaggacgtaattaaaccgg

SEQ ID NO: 172231 - DNA, 513 bp, Homo sapiens
  misc_feature: GYAE6OF02IM2XQ.27.78.H01.1.454.CMB.1.raw
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
tcagagcgtcgtctcacgaccggtgctcgatttagtgtgagtagtttgggtttgggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctccaaagctcctcatcaagtatgcttcccagtccttctcacgggtcccctgaggttcagtggcagtggatcgtgggactacatttccaccctcacctatcaatacgcctaggaacgctagaagactgctagactaacttattactgtcatcagatacttacttaccntagtnatcaccttcggaccaaggactacgacgtggagtaataacgactgtcggctgcactatctgtctac

SEQ ID NO: 172232 - DNA, 630 bp, Homo sapiens
  misc_feature: GYAE6OF02FTPCR.27.78.H01.1.454.CMB.1.raw
  modified_base (409)..(409): a, c, t, g, unknown or other
  misc_feature (409)..(409): n is a, c, g, or t
tcagagcgtcgtctcacgaccggtgctcgatttagtgtgagtagtttgggtttggggatgagacaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgcccgggccagtcagagcgttgggtagtagtcttacacgtggtaccagacagaacgccgaggtcagtcctaccaaagtcctcctacatacaagtatcgccttcccacgtccttcctcgtacgggtcccctacggtacggttcgagtggcgaggtggactcgtagggacactactttccaccctcaaccatacaanacgtccgtaggaacgctagaagacgtgcgtacgacctaacttacttactgtaccgtaatccgtaagtacgttaacctttaccgtttaaccgttactaaagtcgtaactaccttaccgttccggaccgtaaacgggtacgaaccgtacggtacggaacgttaacggttaaaccgaacgttggacggtacgtacacgtaacctactacgttcgttaccttccg

SEQ ID NO: 172233 - DNA, 588 bp, Homo sapiens
  misc_feature: GYAE6OF02IR8BK.27.78.H01.1.454.CMB.1.raw
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaatccaccatcacctcggccgggccagtacagagcgttacggtagtagtcttacactggtaccagcagaagccaggtcagtctccaaagctcctcgatcaagtatcgccttcccagttcccttctcgtacggggtcccctcgacggttcagtggacaggtggagtcgtgggaccactaatttccacccctacaccctaatcaaactacnccgtaggtaacnctgaaggaatcgctagactaacgttatactntctatcagtaacgttacgtactttacctactaaggttacacttaccgtaccttaccggaccgtaaacggaccgtacggtaacgtaggaacgtaagttaaaaccgg

SEQ ID NO: 172234 - DNA, 615 bp, Homo sapiens
  misc_feature: GYAE6OF02G9VFI.27.78.H01.1.454.CMB.1.raw
  modified_base (376)..(376): a, c, t, g, unknown or other
  misc_feature (376)..(376): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaacgtcaccatcacctgccggccagtcagagcgttggtagtagcttacactggtaccagcagaagccaggtcagtctccaaagctcctcatcaagtatgccttccacgtccttctcgacgggtcccctcgaggttcagtcggcngtggatcgtgggacactagttccaccctcaccataccaatacgccgtagggaacgtcgtaggaaagtatcggtacgtacgtaccttaaactttacttaacgttcgtactacttacgtaacgtaacgttaaccttaaccttttacctacgtaacgttcgtaaccttacccgtaacccgttaccggaaccggtaaacgggtaccaaccggtacgtacgggaacgtaacgtttaaaaccggg

SEQ ID NO: 172235 - DNA, 557 bp, Homo sapiens
  misc_feature: GYAE6OF02G8JVH.27.78.H01.1.454.CMB.1.raw
  modified_base (398)..(398): a, c, t, g, unknown or other
  misc_feature (398)..(398): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctgacggttcagtcggcaggtggactcgtgggacactactttcaccctcaccatcaatagcctaggaagctagaagntgctgtactaacttacttaactcgtcatcgaagtaagttaccttaacttttacctactaagtgtaactcctaccgttacggaccgaagggaccacggactaggaacgtaacttaaacgtaacgtggtacggtctacgccaacctatcttgtaccttacc

SEQ ID NO: 172236 - DNA, 614 bp, Homo sapiens
  misc_feature: GYAE6OF02JU1N5.27.78.H01.1.454.CMB.1.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcaggagcgttggtagtagcttacactggtaccagcagaagccaggtcaggtctccaaagcctacctcatcaagtatgacttcccagtccttctcgacggggtcccctggacggttcaggttcgctaggtggntcgtagggacacgtacttccnccctacaccatacaatacgcctaggaanctgaagagtgtctacgactaactttacttacttatacgtactcgtaagtacgttaaccgttacctttaaccctacgtaaagtcgtaacttccgtaacccgttaccggtaccgaacgggtaaccacggtacctagggtaacttaaacgttaaaccgtaacgtagggttaccggacttaccggaccacccgtacgttcgtacgttaccc

SEQ ID NO: 172237 - DNA, 591 bp, Homo sapiens
  misc_feature: GYAE6OF02HBV5U.27.78.H01.1.454.CMB.1.raw
  modified_base (295)..(295): a, c, t, g, unknown or other
  misc_feature (295)..(295): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctacatcaagtntgccttccagtccttctcgacgggtcccctgacggttcaggtgcagtggatcgtgggacactactttccaccctcaccatacaatacgccgtaggaacgtctagaagagtgactagtactaacttacttaacttgtactaacgtcgaagtaacgttaccttaactttaacctacgtaagttacgacttacctacccgttcggaacccgaagggtaaccaccgtagtacggaacgtaaacgttaaacgtaacgttggtacggtcgtacgtacgacctacgtacttcgttacttaccg

SEQ ID NO: 172238 - DNA, 746 bp, Homo sapiens
  misc_feature: GYAE6OF02JPJQC.27.78.H01.1.454.CMB.1.raw
  modified_base (380)..(380): a, c, t, g, unknown or other
  misc_feature (380)..(380): n is a, c, g, or t
  modified_base (418)..(418): a, c, t, g, unknown or other
  misc_feature (418)..(418): n is a, c, g, or t
tcagagcgtcgtctcacgaccggtgctcgatttagtgtgagtagtttgggtttggggtagtcttaaaagaaggttctttctctgggagtgtggcatgagcaaaactgacaagtcaaggcaggaagatgttgccatcacaactcattggttctgctgctctgggtccagcctccgagggtgaaattgtgctgactcagtctccagactttcagtctgtgactccgaaaaggagaaagtcaccaatccacctggccgggtccagtcagagtcgttggtagtagcttacgcctaggtacccagacaacggaagccgaggtacacggttacctacccaaagtcctcctccaacttccgaaagttacgtacgtccctttaccccncggtttacccttccgttacgaaccgggggtttcccccncggttacggttaccgttaggtacggtcctaagggtggtacttacggtcggggaacttaccctaagttttcccaaccccgttcaacccctagttcaaacgtacgtcccgtagggaaccgtcgtaagaacttagtcgctacgtaacccttaacgttttaactacccttacggttacctagttaccgaaacggttaattttaaccccgtttaaccttttacccgttaccgtaacgggttaaccgtattaaccccgtttacccgttaaccggaccccgtaaacgggtaccgtaccgtaaccggtacgggttaaaccgaagtttaaaacccgg

SEQ ID NO: 172239 - DNA, 588 bp, Homo sapiens
  misc_feature: GYAE6OF02GZQ0E.27.78.H01.1.454.CMB.1.raw
  modified_base (298)..(298): a, c, t, g, unknown or other
  misc_feature (298)..(298): n is a, c, g, or t
  modified_base (427)..(427): a, c, t, g, unknown or other
  misc_feature (427)..(427): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtgcttacactggtaccagcagaacgccaggtcagtcctccaaagctcctcatcaagtntgtccttcccagttcccttctccgacggggtcccctcggtacggttccgaggtggctaggtggattccgtagggacacgtactttccacccctcaccctatacaactacgccgtaggaacgctagaagntgctgactaacttattactgtacatcaagtacgttaacttactttacctagtaacgtgtacttcctaccgttacggaccgtaacgggacctaccggtacgtaggacgtaaacgttaaaccgagttacggtcgacgtacgaccacgtacttccgtagttccc

SEQ ID NO: 172240 - DNA, 727 bp, Homo sapiens
  misc_feature: GYAE6OF02IM709.27.78.H01.1.454.CMB.1.raw
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccacctcggccgggccagtcagagcgttggtagtagcttaacactggtaccagcaagaacgccaggtcacgtctaccaaagcctccctnaactcaagtntcgtccttcccacgttcccttctccgtaccggggtcccctcggtacggtttcagggtacgcgtaggtggactcggtagggaacctactaccgtttaccaccccgttccaaccctactactaaagttaccgacccgttagggaacgtcctaaggaacgtacgttacgtccgtacggtaaccttaaactttacgtttaaccgttgttaacccgtagttaacccgtaacggtttaaaccgttaaccttttaaccctttttaccgtaaccggttaaaggtcggttaaccttacccgttaaccccggtttaccggggaaaccccggtaaacgggaccgttaaacccggtacggttaacggggtaaacgttaaccggttaaaaacccggg

SEQ ID NO: 172241 - DNA, 605 bp, Homo sapiens
  misc_feature: GYAE6OF02IXENK.27.78.H01.1.454.CMB.1.raw
  modified_base (228)..(228): a, c, t, g, unknown or other
  misc_feature (228)..(228): n is a, c, g, or t
  modified_base (331)..(331): a, c, t, g, unknown or other
  misc_feature (331)..(331): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactcaaagganaaagtcacatcactcgccggccagtcagagcgttggtagtagcttacactggtaccagcaagaacgccaggtcagtcctacaaagcctcctacatacaagtancgtcttcccagtcctctacgacgggtccctgagttcagtgacagtggactcgtaggacacgtacttcaccctacacctactacaactacgcccgttaggaaacgcctaaggaacacgtacgtacgtacgacctaaactttacgttaactacggttacaattccgaagtaaacgttacttaaccttttactacctaaagtacggtaactccgtaaccgttccggaaccgaaacggtacctaaccggtaacgtaacgggtacaacgttaaaaccgg

SEQ ID NO: 172242 - DNA, 530 bp, Homo sapiens
  misc_feature: GYAE6OF02FUYVS.27.78.H01.1.454.CMB.1.raw
  modified_base (230)..(230): a, c, t, g, unknown or other
  misc_feature (230)..(230): n is a, c, g, or t
  modified_base (420)..(420): a, c, t, g, unknown or other
  misc_feature (420)..(420): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagacgtttcagtctgtgactccaaaggnaaagtcaccatcacctgccggcagtcagagcgttggtagtagcttacactggtaccagcagaagccaggtcagtctccaaagctcctcatcaagtatgcttcccagtccttctcacggggtcccctgaggttcagtggctagtggatcgtgggacacatttcacccctcaccatcaatacgcctggaacnctagaagatgctgactaacttattactgtcatcagatactacttaccactagtgattccaccgtttcggaccgtaagggacctaacggtactaggagtagttaaacccgg

SEQ ID NO: 172243 - DNA, 776 bp, Homo sapiens
  misc_feature: GYAE6OF02JTVEZ.27.78.H01.1.454.CMB.1.raw
  modified_base (141)..(141): a, c, t, g, unknown or other
  misc_feature (141)..(141): n is a, c, g, or t
  modified_base (269)..(269): a, c, t, g, unknown or other
  misc_feature (269)..(269): n is a, c, g, or t
tcagagcgtcgtctcacgaccggtgctcgatttagtgtgagtagtttgggtttggggtagtgagcaaaactagacaagtcaaggcaggaagatgttgccatcacaactcattggtttctgctgctctgggttcagcctccngggtgaaattgtgctgactcagtctccagtactttcagtctgtgactaccgaaaggagaaacgtccaccatccacctggccggcctagtcaggagcgttggtagtagtcttacatcggtaccagcganaaggcctaaggtcacgtcctaccgaaagtctcctacattacaagtacgtctaccgttacccctagttacccttccgtaccgtaccggggttccccctacggtacggttacctagggttacgggctacgggttacgggtactttccggtcggggaaacctaactttaacctttcccggtaacccccttacgtaaccccgtaagtttaacccaaaacggtttcggaccccgttaagggaaaccttccggtaaagaaaccggtaattcggctaacggtactaaacctttacgttacgttacggtactacgtaccgtaggtaacccttacctttaaacgttccttaaacgggacgttaagtacccgttaccgttaaacccttacggggtacccgtaaacgggtaaccacccggtaggtaacggtaaccggtaaaactttaacggaaacccggtttggaccggttaccggtcccgaaccgtaaccgtcttaaccggttgtacccttttaccg

SEQ ID NO: 172244 - DNA, 670 bp, Homo sapiens
  misc_feature: GYAE6OF02IC8UR.27.78.H01.1.454.CMB.1.raw
  modified_base (270)..(270): a, c, t, g, unknown or other
  misc_feature (270)..(270): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatcacctgccgggcagtcagagtcggttgtagtgtacttacactggtacagcagagcaggtcngtctacaaagcctctacatactaagtatcgccttcccacgtttcctctaccgtcgggtcccctacggtacgttacaggtcggcgtaggtacgtacgtcggttaggacctaacgtacttttcccaccctacgaacctacttacaaacgtcgtacccgtaaggaacgtccgtaggaaatacgtactcgtacggaacttaaacttttagttaccgttagtactattacgaacggttaactaacctttacctttaaccgtacgtaagtacgtaactcccgttaacctttccgggaaccgaacggtacctaccggacgttacgggtaactaaaacgttaaccggtaacgttcgggtaccgacggtacgtaaccaaccgttaccgtttcgtccgttaccttacccg

SEQ ID NO: 172245 - DNA, 546 bp, Homo sapiens
  misc_feature: GYAE6OF02H7H25.27.78.H01.1.454.CMB.1.raw
  modified_base (200)..(200): a, c, t, g, unknown or other
  misc_feature (200)..(200): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagctttacactggtaccagcagaagccaggtcagtctccaaagctcctcatcaagtatgcttcccagtccttctcgacgggtcccctcgaggttcagtggcagtgatcngggacacatttcaccctcacctatcaatagcctaggagctgaagatgctgctaattattactntcattcagtacgtacttaactttacctactaagtgacttacctaccgttccggacccgaagggaccacgacgtaggaagttaacttaaacgtaaccgttagtacggcttacgcctaaccattccgtgttacc

SEQ ID NO: 172246 - DNA, 524 bp, Homo sapiens
  misc_feature: GYAE6OF02FH7G3.27.78.H01.1.454.CMB.1.raw
  modified_base (502)..(502): a, c, t, g, unknown or other
  misc_feature (502)..(502): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgcccgggccagtcagagcgttggtagtagcttacactggtaccagcagaagccaggtcagtctccaaagctcctcatcaagtatgcttcccagtccttctcacggggtcccctcgaggttcagtggcagtggatctgggacacgtactttccaccctcaccatcaatgcctggagctgaagtatgctgactaacttacttacttgtactatacagtacgtacttactttacctacaagtgatccaccttcggaccaaggacacgtactggagtaataaacgactgtcggntcgacacctatcgtctcttacc

SEQ ID NO: 172247 - DNA, 681 bp, Homo sapiens
  misc_feature: GYAE6OF02JOTOR.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaagganaaagtcaccatcacctgccggcagtcagagcgttggtagtagcttacactggtaaccagcagaacgccaggtcacgtctaccaaagctccgtcatacaagtatcgccttccagtccttctcgtacgggtcccctagtacggttccgtaaggtcggaccgaggtcggaacgttcgtacggggaacctacgtactttaccgaacccctcgaaccctaactactaaacgtaccgtacccgtagggtaaacgtacgttaacggaaacgtacgtacggtacctacggtaacctaaaccgtttaacttaacgttcgtaactacgttacgaagtaccgttaactttaacgtttaaccttaacgtaagttacgtaacttaccgtaccgttaccggtaaccgtaaacggaccgtaaccgtacgtaaggaaccgtaagttaaaccgtagttacggtacgtactacgaccgtacctacgtacgttacgtccttaccg

SEQ ID NO: 172248 - DNA, 569 bp, Homo sapiens
  misc_feature: GYAE6OF02GF59K.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcaagaagccaggtcagtcctaccaaagctcctcactcaagtatcgcttcccacgttccttctcgtacggggtcccctcggaggttccaggtggcaggtggctcgtgggacacactttcaccctcaccatacaatacgcctggaacgtctagaagatgcttacgactaacttattactgtactatacaagagttaccttactttacctactagtgtacttacctacccgttcgaacccggaaggtaccaaccggtactaacgggtacgtaagttaaaccgg

SEQ ID NO: 172249 - DNA, 754 bp, Homo sapiens
  misc_feature: GYAE6OF02JQ581.27.78.H01.1.454.CMB.1.raw
  modified_base (226)..(226): a, c, t, g, unknown or other
  misc_feature (226)..(226): n is a, c, g, or t
tcagagcgtcgtctcacgaccggtgctcgatttagtgtgagtagtttgggtttggggtagtgagcaaaactgacaagtcaaggcaggaagatgttgccatcacaaactcattgggtttctgctgctctgggttccagcctccaggggtgaaattgtgctgacctcgtctctacacttactactcgtgtgtacgaacctaacgaaaggaagtaacgtaccacctacnccgtccgtccgggtccgagtcacgagcgttggtagtagcttacgactggtaccagcacgaagccaggtcgtacgtactaccaacgacctcctacactactacgtactcgtaccgttaccctacgtccgtaccggtcccgtacgggtacccggttccgtacggttcggaccgtcggtgtacgtcgggtcccgtacgtacttacttaccttaccctacccgtacctacctaactaacgtacgtcgtaaccggtacgtacgtaaacgtacgtaggtacttacgtcctaaccgttaactttaaccgttacgaaccgttaacttaccgtaacgtaacgttaacttaaccgttttaaccctttaccttaacgttacgtaacgttaccgtaacccgttacccgtacccgtaaaccgggtaaccgaaccggtaaccgttacggtacggtaacgttaaaccggtaaaccgttccggtacgttacggtaccgtaccggtacgtaccgtacgttaccgttaccttaccttaccttaccg

SEQ ID NO: 172250 - DNA, 675 bp, Homo sapiens
  misc_feature: GYAE6OF02IRCLR.27.78.H01.1.454.CMB.1.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagactttcagtctgtgactcaaagganaaagtcaccatcacctgccggcagtcagngcgttggagtagcttacgactacggtaccagcaagaacgccaggtcacgttcctaccaaagcctcctacactacaagtatgccttaccacgttccttaccgtcgtaaccggggtcccctcggtaacggtttcacggttcggcctagtacggactcgttacgggacctacctagttttacccaccccttaccgaacctacgttaaccaaacgttacggcccgttaaggaaacggtcttacgggaaacgtacgttcggacttacgaaccttaacgttactttaacgtcgtactactcgtaaagtaccgtttaaccttacgtttacccacgtaaacgttcggtaacttacccgtaaccgtttacggaacccgtaaagggaccctaacggtaccgtacgggtaaccttaaaggttaaaacccg

SEQ ID NO: 172251 - DNA, 755 bp, Homo sapiens
  misc_feature: GYAE6OF02IF849.27.78.H01.1.454.CMB.1.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
tcagagcgtcgtctcacgaccggtgctcgatttagtgtgagtagtttggggtttggggatgagacaaaactgacaagtcaaggcaggaagatgttgccatcacaactcattgggtttctgctgctcgtgggttccagcctccaggggtagaaattgtgctgactcagtctcagtactttcagtctgtgactaccaaagganaaaagtcaccatccactcggccgggccagtcagagcggttggtagtagcttacnctaggtaccagcagaacgccaggtcacgtctaccaaacgtctcctacataccaaagttatcgtaccttccctacgttccctttctcgtaccggggttcccctggtacggttcaggtcggacgtaggtggtacgtcggtacgggacctacgttactttacccacccctacctaaccctactacgtaaacttacggaccgtacgggaacgtacggtacggtaaaggacgtacgtacgtacgtacctaactttaactttaacgttacgttactactacgtaacgtaacgttaaccttaacctttaaccgttaacgtaacgtacgtaacgttaccgttaccgttaccggtaaccggaaaccgggtaaccgtaaccgtacggtaacgggtaacggtaaacgttaaaaccggttaaaccggaacggttttttttttttttttttttaccggaccggttaccgtaacccgtaacccgttacgtttaccgttaccgttccgtttaccc

SEQ ID NO: 172252 - DNA, 641 bp, Homo sapiens
  misc_feature: GYAE6OF02ISA8C.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaagtcacatcacctgccggccagtcagagcgttggtagtagcttacactggtaccagcgagaacgcaggtcagtctcaaagctcctcatcaatatgctcccagtccttctcgacgggtccctgacggttccaggtggcaggtgactcgtgggacacgtacttccaccctcacctataccaaatacgaccgttgggaaacgtcgtagaaagtctacggcttacgactaaaccgtttatttaaccgtgttaccgtaattaaccgtaacgttaaacgttaacctttaccctttttaacccgtacttaaacgggttcgttaacttaccggttaaacccgtttacccggaacccggttaaacggggaacccaaaccgggttaaccggtacggaaaccggttaaacgtttaaaaccggg

SEQ ID NO: 172253 - DNA, 527 bp, Homo sapiens
  misc_feature: GYAE6OF02F0827.27.78.H01.1.454.CMB.1.raw
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtgcagtgatctggacacgactttcgaccctcaccactacaatagaccctaggaacgctagaagatcgctgactaacttacttactgtacatcacgtattaccttactttaccactaagtnactcaccttcgacctaaggacacgacgtaggacgtaattaacgactgacggtcagaccacctatctagtcttac

SEQ ID NO: 172254 - DNA, 525 bp, Homo sapiens
  misc_feature: GYAE6OF02F8JW0.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacattcaccctcaccatcaatacgcctaggaagctagagatgctgacaacttattactgtcatcagtacgtacttacttacctcaagtgacttcaccttcggaccaagggacacggactgggaacagttaaacgacttaggtaggccttggacctaaccacttcctgttacc

SEQ ID NO: 172255 - DNA, 619 bp, Homo sapiens
  misc_feature: GYAE6OF02JUF33.27.78.H01.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcggttggagtagcttacacgtggtaccagcagaagccaggtcagtctaccaaagcctccncatccaagtactcgccttcccagttccttctcgacggggttcccctggtacggttcacggtcggctaggtgagtcgtagggacacgtaactttccgaccctcaccatacaatacgcgtggaagccgtagaacgntcggcttacgaccttaaacgttacttacgtgttaccatccgaagtaccgttacttacctttacgtactaagttacgtacttaccgtaccgttaccggacccgtaagggaaccaacggtaccgttaggtaactaaacggttaaacgtaacgtcggttacgaccgttaccacgtacccttatcgttacgttcttaaccg

SEQ ID NO: 172256 - DNA, 631 bp, Homo sapiens
  misc_feature: GYAE6OF02GZXRJ.27.78.H01.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatccacctgccgggccagtcagagcgttggtagtgcttacactggtaccagcagaagcaggtcagtctaccaaagctcctnatcaagtatgtccttcccacgtccttcgtcgacggggtcccctcggtacggttcaggtgcgaggtggagtcgtgggactacgtactttaccaccctccaacctatactaactacgccgtaggtaagcgtagaagtatgctcgactaactttacttactcgtacatcgagtacgttacttactttaccgtactacgttagtaaccttaccgtacccgtttaccggaccgtaaacgggtaccaacccgggtataacgggtaacgttaaacggttaaacgtaacggttacggtacggtaccgttcggaaccttaaccgtactttaccggttcgttaccctttacccgg

SEQ ID NO: 172257 - DNA, 572 bp, Homo sapiens
  misc_feature: GYAE6OF02F4YSJ.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggttttctgctgctctgggttccagcctccaggggtgaaattgtgctgactcagtctccagtactttcagtctgtgactccaaaggagaaagtcaccatcacctgccgggccagtcagagcgttaggtagtagcttacactgtaccagcagaagccaggtcagtctccaaagctcctcatcaagtatgcttcccagtccttctcgacggggtcccctcgtaggttcaggtggcagtggatcgtgggacactatttccaccctcaccatacaatcgcctggaacgctgaagatgctgactaacttattactgtcatcagtacgttacttacctttacctctaacgttgacttcctaccgttccggaccgtaacgggaccacggacgtaggaacgtaacgttaaaaccggtacgttaggtacggacgttacggacctaaccgacttacgttacgtttcccg

SEQ ID NO: 172258 - DNA, 580 bp, Homo sapiens
  misc_feature: GYAE6OF02FL5YX.27.78.H01.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccgggccagtcagagcgttggtagtagcttacactggtaccagcagaagccaggtcagtctccaaagctcctcatcaagtatgcttcccagtccttctcacggggtcccctcgaggttcaggtggcaggtggatcgtgggacactatttccaccctcaccatacaatacgcctggaacgctgaaagtatcgctgcctaacttattacttgtcatcagtacgttaccttactttacctagtaagttcgtaactcgtacccgttaccggtaccgaaacgggtaccaacggtcgtagggaagtaaacgttaaaccgaaacgttcggacggtctacggccaacccgtaactcgtttacgttacttacccg

SEQ ID NO: 172259 - DNA, 764 bp, Homo sapiens
  misc_feature: GYAE6OF02GOG75.27.78.H01.1.454.CMB.1.raw
tcagagcgtcgtctcacgaccggtgctcgatttagtgtgagtagtttgggtttggggtagtcttaaaagaaggttctttctctgggatgtggcatgagcaaaactgacaagtcaaggcaggaagatgttgccatcacaactcattggtttctgctgtctctgggttccagcctccgaggggtgaaattgtgctgactcagtctccagtactttcagtctgtcgactacgaaaggtagaaagtccacctaatccaccgtcggccggccagtcagagtcggttggtagtgtactactagtcggtacctacgcgaagtaacgaccgacggtacgagtcctaccgaaacgtccgtacctctaactactaaacgtataccgtccgttaccctacggttcccttaccgtccggtaaccggggttcccccgtaggttaacgggtttccgacgttacgggggtctaacggttaggggtaccttcggtaacggggtaccgtacgttaactttcccgtaaccctaccgtaccctaactacctaacgtacggtacccttagggaaaccgtacgttacggaaagtacggtacgtccgtacggtaaccgttaacctttactttaaccgttagttaccgtacgtaaccgttaaggtaaaccggttacctttaccgtttaccttacggtaaacgtttaccgaacttaccggtaaccccgttacggtaccggtaaccggtaccgaacgttacggtaacgtaacggaacgtttaaaccggg

SEQ ID NO: 172260 - DNA, 594 bp, Homo sapiens
  misc_feature: GYAE6OF02JFC17.27.78.H01.1.454.CMB.1.raw
  modified_base (309)..(309): a, c, t, g, unknown or other
  misc_feature (309)..(309): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccaggtcagtctccaaagctctcatcaagtatgcttcccagtccttcncgacgggtcccctcgacggttcaggtggcaggtggattcgtagggacactactttccaccctcaccactcaacttacgcctaggaacgctagaagtatcgctacgtacctaactttattacctacgttactacgttacaagtacgttaacctttacctttacctaccttaaagtcgtaacttacctaccgttcgggacccaaagggtaccaacgtacgtaggagtaacttaaaccggacgtggttacgcgttacggacctaacgtacttccttagttccttaccg

SEQ ID NO: 172261 - DNA, 675 bp, Homo sapiens
  misc_feature: GYAE6OF02JWLSR.27.78.H01.1.454.CMB.1.raw
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttggggagtgagcaaaactgacaagtcaaggcaggaagatgttgccatcacaactcattgggttctgctgctctgggttccagctccaggggtgaaattgtgctgactcagtctccagactttcagtctgtagactcaaaggacgaaagtcaccatcacctgccgggaccagtccagacgtcgttggtacgtacgnttacacgtggtaccagcaggaacnccaggtcagtctccaaagcctcctacataccaagtactcggtcttcccgagttcctctccgacggggttcccctaggacggttcgagtcggacgagttacgggaacttcgtagggacctaatcccgttttacaaccccgtttcaaccgtactaccaaaagtttccgaccgtagggaaactcggttagaaaccggtntacgtcgtacgtaccttaacgttagttacgtatcgaacgtacgtaacgtacttacctttaaccgttaacggacgtaaggttacgtaactaccgttaccgttaccggaacgtaacggacctaacggtacgtacggtaacgtaaccggttaaacgacgttacggtcgaaccgttcgacccgtaacgttcctcggttaccgttaccctacg

SEQ ID NO: 172262 - DNA, 707 bp, Homo sapiens
  misc_feature: GYAE6OF02ID5PR.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagtactttcagtctgtgactaccgaaaaggagaaagtcaccatcacctgccgggccagtcagagcgttaggtagtacgcttacacgtcggtaccagcaagaacgccgaggtcagtcctaccaaagccttccctcactacgaaagttatcgccttccctacgttcctttctaccggtaccggggtccccctaggtaggttccgaggtcggacgtagggtgagtcgtagggacctaacgtactttacccacccttaccaaccctatacctaaagtacggtacccgtagggtaaacgcgtagaaagtatcgacgtcgtaacctaaactttacttaacgtgttactactacgtagtaacgttaccttaacttttaacctactaaacgttcgtaaccttacctaacccgttacgggaacccgtaaacggggacctaaccggtaacggttaagggaaacgttaaaccttaaaaccggtaccgtttaacggttacggtaccgttacgtacccgaacccgttatttacccgttcgttttacccc

SEQ ID NO: 172263 - DNA, 658 bp, Homo sapiens
  misc_feature: GYAE6OF02HXTX3.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcattgggtttctgctgctctgggttccagcctccgaggggtnaaattgtgctgactcagtctccagtactttcagtctgtgactccgaaaaggagaaacgtcaccatcacctggccgggcagtcagagtcgttggtagtagcttacacgtggtaccagcaagacgccaggtcagttcaccaaagcctaccgtcatacaagtatcgtccttcccagttccttctcggacgggtcccctggtacggttcagtcggcaggtggactcgtagggacactactttaccacccgtcaccgtacttacaagtacgaccgtaggaacgtcgtacggaagtacgtcgaccgttagaaccttaaaccgtttaatttaccgtacgttacctacgttaccgaaggtaaccgtttaacccttaaccgtttttacccaacgtaaacggtcgtaacttaacccgtacccgtttaccggaacccgtaaacgggacctaaaccggtccggtaacggtaacgtaacgttaaaaccgg

SEQ ID NO: 172264 - DNA, 551 bp, Homo sapiens
  misc_feature: GYAE6OF02GQU4M.27.78.H01.1.454.CMB.1.raw
  modified_base (300)..(300): a, c, t, g, unknown or other
  misc_feature (300)..(300): n is a, c, g, or t
  modified_base (468)..(468): a, c, t, g, unknown or other
  misc_feature (468)..(468): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggcagtcagagcgttggtagtagccttacactggtaccagcagaagccaggtcagtctaccaaagcctcctacatcaagtntcgccttcccagttccttctcgacggggtcccctggtacggttcaggtggcaggtggatcgtagggacactactttccaccctcaccatacaactacgcctaggaacgtctagaagatgctagactaactttattactgtcatcagtagtacttacttaccataagtnactcacctcggaccgaaggaccacgtagtaggaacgtaactaacgaacttggacgtacgtacgactacctagttcctgttacc

SEQ ID NO: 172265 - DNA, 596 bp, Homo sapiens
  misc_feature: GYAE6OF02GDKHG.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttggggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatacaagtatcgccttcccagttccttctcgacggggtccctcgtaggttcagtggcagtggatcgtgggacactacttcaccctcaccactacaatacgcgtaggaactcgtaggaaacgtgtcgtactagtacctaaactttactttacgttcgtactactacgtaagtacttaaccttaacctttaacctacgtaaagttctacttacctacccgttacggaccgtaagggacacgtacgtagggaacgtaacttaaacggtacgtgtaggacttacggacctaccgattccgtattcccg

SEQ ID NO: 172266 - DNA, 549 bp, Homo sapiens
  misc_feature: GYAE6OF02G0JRF.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggccagtcagagcgttggagtagcttacactggtaccagcagaagccaggtcagtctccaaagctcctcatcaagtatgccttcccagtccttctcgacgggtcccctcgaggttcagtggcagtggatcgtgggacactatttccacctcacatacaatcgcctaggaagctagaacgatgactgactaacttattactgtacatcagtagtacttacttacctatagtctactacctaccgttccgacgaaacgggacacggacgtaggaacgtaagttaaaccgaagttggtacggtactacggaccaccgtatccgtcgttacgtttacc

SEQ ID NO: 172267 - DNA, 558 bp, Homo sapiens
  misc_feature: GYAE6OF02FHOSE.27.78.H01.1.454.CMB.1.raw
  modified_base (309)..(309): a, c, t, g, unknown or other
  misc_feature (309)..(309): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtccaccatcacctgccgggccagtcagagcgtttggtagtagcttacactggtaccagcagaagccagtcagtcnccaaagcctcctcatcaagtatgccttcccagtcccttctcacggggttcccctcgaggttcagtcggcaggtggatcgtggggacacgactttcacccctcacccatcaaatagcctaggaacgtctagaacgatcgctgaccaacgtttattaccttgtacatcagtacgttacttactttacctactaagtgactcgtacccttcggacccaagggaccaacggacacggtagtaacttaaaccgg

SEQ ID NO: 172268 - DNA, 558 bp, Homo sapiens
  misc_feature: GYAE6OF02HI7WU.27.78.H01.1.454.CMB.1.raw
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggagtagcttacactggtaccagcagaagccaggtcagtctccaaagctcctcatcaagtatgcttcccagtccttctcgacgggtcccctcgagttcagtggcagtggatcgtgggacactatttccacccttcaccatcaatacgcctagggaacnctagaagatgctagactaaacttattactgtacatcaagtacgtaacttacctttaacctactaagtgacttccgtaccgttacggaccgaagggaccacggtaacgtagggaataacgttaaacgaacgttggtacggctcgaccaaccgtattcctgttacc

SEQ ID NO: 172269 - DNA, 527 bp, Homo sapiens
  misc_feature: GYAE6OF02F34OJ.27.78.H01.1.454.CMB.1.raw
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcacggggtcccctcgaggttcagtggcagtggatcgtgggacactatttccgaccctcaccatcaatacgcctagggaacgctagaagatgctgactaacttattactgtcatcagactacttactttacctntaagtgtatcctaccttcgacctaagggaccacggactggaataagttaaacgactgtgctagacaccatcgtgtcttaccg

SEQ ID NO: 172270 - DNA, 581 bp, Homo sapiens
  misc_feature: GYAE6OF02GAHBZ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccgaaaaggagaaagtcaaccatccacctggccgggccagtcagagtcgttggtagtagcttacacgtggtaccagcagaagccaggtcagtctccaaagctcctcatcaagtatcgccttcccacgtccttctcacggggtcccctcggtggttcagtggcaggtggatcgtgggacacgtatttccgacccctcactactacacgacgtcgagacgtcgagatacgtcgtcgactaacttaattactacgttctatctacgagtacgtaccttaccttactaacgtagtactactaccgttaccgtacgaaccggaacgacgacgtacgaggaacgttaaacgaacgtacgtggtacgtagtacaccgtaactacgtcttcgtacttaccc

SEQ ID NO: 172271 - DNA, 697 bp, Homo sapiens
  misc_feature: GYAE6OF02H4C6A.27.78.H01.1.454.CMB.1.raw
  modified_base (164)..(164): a, c, t, g, unknown or other
  misc_feature (164)..(164): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggtagtcttaaagtaaggttctttcttctgggagtgtggcatgagcaaaactagacaagtcaaggcaggaagatgttgccatcacaactacattgggtttctgctgctntgggttccagcctccgaggggtgtaaattgtggctggtactcagtcctccagtacttttcgattcgtgtaggaccttacccgaaaagggagtaaaacggtcacccaattcaacccgtggcccgggcagtcacgagtcgttggagtancgttaacnctagggtaccagacaagaacgccaagtccagtctccaaacgctccctanatacgaagttctcgtccttacctacgttcctccgtacggacggggttccctcggtacgttacgnggtcggcgtagtacggtactcgtacggactaacgttaactttccgtaaccctacacctaactacgtaaccgtcggtacgtaggtaaccgtgtacgaaacgtactgaccgttcgtaaccttaacttatttaccgtagtcttaacgtacgaacgttaacgttacctttaaccttaccgtactaacggtacgtaccgttactaccccgttaacgggtaaccggtaacgaacgttaaaccggtacggtaacgtaccggtaattaaacgg

SEQ ID NO: 172272 - DNA, 603 bp, Homo sapiens
  misc_feature: GYAE6OF02IHWMI.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaagganaaagtcaccatcacctgccgggccagtcagagcgttggtagtagcttacactggtaccagcagaagccaggtcagtctccaaagctcctcatcaagtatgccttcccatccttctcacggggtccctcgacggttcagtggcagtggatcgtgggacactatttccaaccctcaccctatacaatagcctggaatctagaagatgctagactaactttattaactcgtataactcaagtaacgttaacttaaccttttaccctacgtaaagttcggtaacttcctaacccgtttaccgggacccgttaaaggggaaccgtaccgacggtaggggtaaacgtaaacttaaaccggaaacttcgggacggtacgtacgacctaaccgtactccgttgttaccc

SEQ ID NO: 172273 - DNA, 528 bp, Homo sapiens
  misc_feature: GYAE6OF02GJQZK.27.78.H01.1.454.CMB.1.raw
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcagggtcccctcgaggttcagtgcagtgatctggacacgatttcaccctnaccatcaatacgcctaggaagctagaagntgctgactaacttattactgtactatcagtagtacttactttaccataagtgatctaccttcggaccgaagggaccacgtacgtaggaagtaacgttaaacgacgtggtagcgtacgccgacctatctcgttacttacc

SEQ ID NO: 172274 - DNA, 506 bp, Homo sapiens
  misc_feature: GYAE6OF02F6IL7.27.78.H01.1.454.CMB.1.raw
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (503)..(503): a, c, t, g, unknown or other
  misc_feature (503)..(503): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtatagcttacactggtaccagcagaagccaggtcagtctccaaagctcctcatcaagtatgcttcccagtccttctcacggggtcccctcgaggttcagtggcagtggatcgtgggacactatttccacccttcacccataccaatacgccgttaggaacgctaggaagatgctgactaacttattactntcatcagtatacttacttacnaagtnatcacctcgaccaaggccagactggatataacgatgtgctgcaccatctntcc

SEQ ID NO: 172275 - DNA, 503 bp, Homo sapiens
  misc_feature: GYAE6OF02JHXRE.27.78.H01.1.454.CMB.1.raw
  modified_base (198)..(198): a, c, t, g, unknown or other
  misc_feature (198)..(198): n is a, c, g, or t
  modified_base (385)..(385): a, c, t, g, unknown or other
  misc_feature (385)..(385): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcccccaggggtgaaattgtgctgactcagtctccagactttcagtctgtgactccaaaggngaaagtcaccatcacctgccgggccagtcagagcgttggtagtagcttacactggtaccagcagaagccaggtcagtctccaaagctcctcatcaagtatgcttcccagtccttctcacggggtcccctcgagttcagtgcagtgatctggacactacttcacctcaccatacatacgcctaggacnctgaagatgctgctaacgttatactgtcatcagtactactacttacacagtgactcaccttcgacgaaggacacgacgtaggagtaactaacgatgtgctcgcaccntactgtcttac

SEQ ID NO: 172276 - DNA, 575 bp, Homo sapiens
  misc_feature: GYAE6OF02GSJYJ.27.78.H01.1.454.CMB.1.raw
  modified_base (230)..(230): a, c, t, g, unknown or other
  misc_feature (230)..(230): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagactttcagtctgtgactccaaagganaaagtcaccatcacctgccggccagtcagagcgttggtagtagcttacactggtaccagcagaagccaggtcagtctaccaaagctcctcatcaagtatgcttcccagtcccttctcacggggttcccctcggacggttcaggtcggcaggtcggatcgtgggaccatactttccaccctcaccatcaatacgcctggaanctagaagntgctgactaacttattactgtcattcgagtaacgttaccttaacctttacctacgtaacgttgaaccttaccgtaacccgtttacggacccgtaacgggaccaaccggtacgtacgggaacgtaacgttaaaccgg

SEQ ID NO: 172277 - DNA, 528 bp, Homo sapiens
  misc_feature: GYAE6OF02HIVJF.27.78.H01.1.454.CMB.1.raw
  modified_base (196)..(196): a, c, t, g, unknown or other
  misc_feature (196)..(196): n is a, c, g, or t
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggcagtcagagcgttggtagtagcttacactggtaccagcagaagccaggtcagtctcaaagctcctcatcaagtatgcttcccagtccttctcacgggtccctgaggttcagtggcagtggatcgtgggacactatttccaccctcaacctagtaccaatacgcctaggaagtcctagaagatgctacgactaacttattactgtacatacagtactacttactttacctacaagtgactctaccgttcggaccaagggacacgactggacgtaataacgagtgtacgntcgccactatctcgtacttccg

SEQ ID NO: 172278 - DNA, 585 bp, Homo sapiens
  misc_feature: GYAE6OF02JI7AS.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggagtgcttacactggtaccagcagaagccaggtcagtctccaaagctcctcatcaagtatgcttcccagtccttctcctacggggtcccctcgtacggttccgacggtggcagttcggattcgtacggggtacctacgtactttccgacccctcaaccctataccaaagtacgccgttaggaacgtctaggaaagtatgctgactaacgtttacttactcgttacatcctaagtacgtacttacctttacctacagttcgatacctaccgtcggaccgtaaggaccgacgacgtaggacgtaaacttaacgacgtagtacggtcgtacgaccacctatcgttagttcttaccg

SEQ ID NO: 172279 - DNA, 589 bp, Homo sapiens
  misc_feature: GYAE6OF02GY16P.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggagtagcttacactggtaccagcagagccaggtcagtctccaaagctcctcatcaagtatgccttcccagtccttctcgacggggtcccctcggtacggttcaggtcggcgtaggtggtatcgtagggacactactttccaccctccaacctatacctaaatacgtaccgtagggaacgtctaggaaagtacgtgctagacctaactttattacctgtctatctagtacgttaccttactttacctactaagtcgacttcctaccgttccggaccgtaacgggacctacggacgtaggacgtaacgtaaaccgtacgtggtacggactacgacctacctatccgttacgtacttcc

SEQ ID NO: 172280 - DNA, 618 bp, Homo sapiens
  misc_feature: GYAE6OF02GVP44.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggtttcagcctccaggggtgaaattgtgctgactcagtctccagtactttcagtctgtgactccaaaaggagaaagtcaccatccacctgccggccagtcagagcgttggtagtagcttacactggtaccagcagaagccgaggtcacgtcctaccaaagcctccctcactacaagtatcgtcctccctacgtcccttctcgtaccggggtcccctacggtacggttcgaggtggccaggtcggatcgtgggacactactttacccaccctaccaccactacaagtacgaccgtaggacgtacgtagaagtatcgactagacctaacttacgttacgtacgtactactacgtaacgtacgttaacttacctttaccttacgtaacgttctaacttccgtaacccgttaccggaccgtaacgggactaaccggtacgtacggtaacgtaactaaacggg

SEQ ID NO: 172281 - DNA, 778 bp, Homo sapiens
  misc_feature: GYAE6OF02IKGIY.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaaggagaaacgtcaccatccacctgccggccagtcagagcgttaggtagtagcttacacgtcggtaaccagcaagaacgccaggtcagtcaccaaagcctcctacatacaaagtactcgtccttcccacgttccctttcgaccggtaaccggggttcccccttaggtaccgggtttacgacggttgggtactaacgggttggaacgtttcgtacggggtaacctacgttaccgttttcccaaccccgtacctaacctaacttaccgaaacgttacgtacccgtaagggtaaacgtacgtaacgggtaaacgtacgtacgtaccgttagtaaccctttaaaacgttttaccgtttaaccgttcggttacccttaaacgttaccgtaaagtacccgttttaaaccctttaaccgttttaccctaaccggttaaggtaaccgttaacccgttacccgttaaaccccgttacccgggaaccggttaaaccggggtaacccgtaaacccgggtaacggtaaacgggtaacgttaaaaccggtttaaaaacccggg

SEQ ID NO: 172282 - DNA, 589 bp, Homo sapiens
  misc_feature: GYAE6OF02IVLR1.27.78.H01.1.454.CMB.1.raw
  modified_base (359)..(359): a, c, t, g, unknown or other
  misc_feature (359)..(359): n is a, c, g, or t
  modified_base (414)..(414): a, c, t, g, unknown or other
  misc_feature (414)..(414): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccagggtgaaattgtgctgactcagtctccagtactttcagtctgtgactccaaaggagaaacgtcaccatcacctcgccggccagtcagagcggttggtagtagcttacactggtaccagcagaagccaggtcagtcctaccaaagcctcctcatcaatatgtccttcccacgttccttctcgccgggtcccctggtacgttcgagtcgcaggtcgagtcgnggactacgtacttccaccctccacactacaatcgaccgtaggactactagaagtntagctagaccttaatttacgttacttgtacattacgaagttactaacttacttacctagtacgtacacttacctaccgttcggaccaacgggtaccacgacgtaagtaacgtaaacgttaacgtaacgtcggtacgtacgtacgtaccctacgtcttacgttacgtccttaaccg

SEQ ID NO: 172283 - DNA, 669 bp, Homo sapiens
  misc_feature: GYAE6OF02HY394.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgcttgactcagtctccagtactttcagtctgtgactacaaaggagaaagtcacatcacctgccggcagtcagagtcgttggagtagcttacactggtaccagcagaacgcaggtcagtctacaagtctcctcatctaagtctcgtcctacccacgttccttcgtcgtaccgggttcccctggtacggttcaggtcgagaggtggtagtcgtagggactacttacgtttaccacccttacaaccctataccgtaagtaccgtaccgtagggaactccgtaagaaacgacttcggtacctacggtaacctttaaacgtttaacgttacttacggtctaacgttacgtaaagtaccgtttaacctttaaccgtttaaccctaagtaacggttactaccgtacccgtaaccgttacccgggaaacgaacgggtaaccacggtacgtaacggtacgtaaacgtaaccgtacgtacggttacgcctacgtacccgtaccttagtaccgttcgttacttaccg

SEQ ID NO: 172284 - DNA, 864 bp, Homo sapiens
  misc_feature: GYAE6OF02I71AV.27.78.H01.1.454.CMB.1.raw
  modified_base (452)..(452): a, c, t, g, unknown or other
  misc_feature (452)..(452): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccgaggggtgaattgtgctgactcagtctccagtacctttcagtctgtgacctaccgaaaggagaagtcaccccatccgacccgtgccgggtcccaggtccaggtaggaccgtttgggacttaacggcctttacgaacctgggtaaccccgaggacgacggaagtacccaacgggttcctacggtacgtccctaaaccgtctacccgttaccacgttctaacggtaacttccgaccgttcccgtacggttacccctttaccggttcccgtacgggggttaccccgttaccgggtaccgggtttacgttaaccgggngtttacgggacgtacgttcggggtaaccgttaccgtacgggttaccctaacccggtaccttttacccgaacccgtttacctaacccgttaacgtaccgtaaccgttacggtaacccgttacgggtaaacggtaccgtacgggtaacgtacgttaccggtaccgttaacggttaccgttaaccgtttaccgttaccttaccgttaccgtaacgttaccgtaaccggttaaccgtttaacccgttaaccgttttaaccgtacgttaacgttaccgttaaccgttacccgtaacccggttaccggtaaccgtaacgggtaccgtacggtacgttaacgggtaacgttaccggttaacgtacgttaccggtacggtaccgtaccgtaccgttaccgtacgtttaccttacgttacc

SEQ ID NO: 172285 - DNA, 572 bp, Homo sapiens
  misc_feature: GYAE6OF02HCBWN.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagttccttctcgacggggtcccctcggtacggttcagtggcctaggtcggtatcgtagggacacgtatttccacccttccaaccatacaatacgacctggaagctagaagatgctagctaacttattactgtcatacgagtacttacttacctttacctactaagtagtactacctaccgttccgaccgtaagggaccacgacgtaggaacgtaacttaaacgtaacgttacgtaggtactacgaccaccgtataccgttgttaccc

SEQ ID NO: 172286 - DNA, 580 bp, Homo sapiens
  misc_feature: GYAE6OF02HG6C9.27.78.H01.1.454.CMB.1.raw
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgccttcccacgttccttctccgacggggttcccctcggtacggttcaggtcggcagtggatcgtgggacactatttccaccctcacctatacctaatacgaccgtagggaacgcgtagaagtatgcgtcgtactaactttattacgtgtactatacagtacgttacttacctttacctactaagtctactaccgtaccgttaccggaccgaacgggtaccacgacgtaggaagtaacgtaaacgtacgtcgtaggtctacgacctaccacgttcgtgttacc

SEQ ID NO: 172287 - DNA, 565 bp, Homo sapiens
  misc_feature: GYAE6OF02JLL8C.27.78.H01.1.454.CMB.1.raw
  modified_base (385)..(385): a, c, t, g, unknown or other
  misc_feature (385)..(385): n is a, c, g, or t
  modified_base (436)..(436): a, c, t, g, unknown or other
  misc_feature (436)..(436): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcaccatccacctcggccggccagtcagagcgttggtagtagcttacgactggtaccagcagaacgccaggtcagtctccaaagcctcctcaatcaagtatcgcttccagttcctctcacgggttcccctgacgttcagtgcagtgctcgnggcacgtctttccaccctcaccatacaatacgcctaggaagccgtgaactntcgctgactaacttacttacgtcgtactatactacgtaacttaccttactttaccacgtacgtagtaccttccgtaccgttccggtaacccgacgggtaccacgtacgtaggaacgtaagttaaaccgg

SEQ ID NO: 172288 - DNA, 665 bp, Homo sapiens
  misc_feature: GYAE6OF02I6WP1.27.78.H01.1.454.CMB.1.raw
  modified_base (146)..(146): a, c, t, g, unknown or other
  misc_feature (146)..(146): n is a, c, g, or t
  modified_base (161)..(161): a, c, t, g, unknown or other
  misc_feature (161)..(161): n is a, c, g, or t
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactnagtctccagactttcagtctgtgactcaaaggngaaagtcaccagtcacctgccggtccagtcagagcgttggagtagcttacactggtaccagcagacgcaggtcagtctccaagctctcatcaagtntgcttccagtccttcgtcgtacgggtcccctcgtacggttcgaggtcggacgagtcggactcgtcgggactactcgttaccgaccctactacctactacaacgtacgacccgttaggaaactcgtacgaagtatacggtacctagtacctaaccgtttacgttaccgtacggttacctaacgtaccgtaacgtaacgttacctttaaccgtttaaccgtacgtaaacgtacgttaccgtaaccgttaaccgttaccgggaacaaaccggggtactaccggtacgtacggtaacgttaacgttaaaccggtcgtaacgggttacgtaaccgtacggtacccgtaccgaacgttaccgttacggttaccttaaccgg

SEQ ID NO: 172289 - DNA, 687 bp, Homo sapiens
  misc_feature: GYAE6OF02IDPIA.27.78.H01.1.454.CMB.1.raw
  modified_base (178)..(178): a, c, t, g, unknown or other
  misc_feature (178)..(178): n is a, c, g, or t
  modified_base (280)..(280): a, c, t, g, unknown or other
  misc_feature (280)..(280): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctctgggttccagcctccaggggtnaattgtgctgactcagtcctccagtactttcagtctgtgactaccgaaaggagaaaagtcaaccatcaccgtgcccgggcagtcaggagtcgttggtagtancttacacgtcggtaccagtacagaacgaccgtaggtacacgtcctaccaacgcctacctcaatactaaagttactcgtaccctttacccacgtttccccttacgttcccgtaccggggttcccctacgggtacggtttaccgtacgggtcgacgtaggtaggtacttcgggttacggaactacgttactttacccaaccctcaacctactacctaatacgtccgaggtaacgtccgagaacgtctcgacctcgtaaccttaactttagttaactgttaccgtaagtcctaaacgttacgtttaaccttacctttaccaacgttaacgtctaaccttacccgtaacccgttacgggaaccgtaacgggtaacctacgggtaactaagggtaccgttaacgttaaacgg

SEQ ID NO: 172290 - DNA, 585 bp, Homo sapiens
  misc_feature: GYAE6OF02GX3K4.27.78.H01.1.454.CMB.1.raw
  modified_base (299)..(299): a, c, t, g, unknown or other
  misc_feature (299)..(299): n is a, c, g, or t
  modified_base (390)..(390): a, c, t, g, unknown or other
  misc_feature (390)..(390): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagcctcctcatcaagtatnccttcccagtccttctcagggtcccctggaggttcagtggcaggtgatcgtggacactattccacctcaccatcaatcgctagagctaganatgctgactaacttattactgtctatcaagtagttacttacctttactacgtaagtcgaacttccgtaaccgtttaccgggaaccctaaaggggaccctaaacggacgttacgggaaacgttaacgtttaaaaccgtaacggttggtacggtacttacggaccctaaccgtacgtttcgttacgttctttacccg

SEQ ID NO: 172291 - DNA, 740 bp, Homo sapiens
  misc_feature: GYAE6OF02FYQDQ.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccagggtgaaattgtgctgactcagtctccagactttcagtctgtgactcaaaggagaaagtcaccatcacctgccggcagtcagagcgttggtagtagcttacactggtaccagcagaagccaggtcagtctaccaaagctcctcatcaagtatgaccttcccagtccttctcgtacgggtcccctggtacgttcagtggcgagtaggactcgtgggactactactttccaccctcaaccctataccaaagttaccgaccttagggaaacgtccgttaagaaaggtacgttacgtacgtacggtaacccggttaaaccttttaaacgtttaaccgttacggtaccttaacgttaccgtaaacgggttaacgtttaaaccttttaaaccgtttttaacccaacgtttaagggttaccttaaaccgttccgttaaacccggtttacccggaaacccgtaaacggggttaacccgtaaccgttaccggttaacggggaagttaaaacccgtttaaaacccggtaaaccgtttaccgggttacggtaccgttaccggtaacccgttaacccgttaacgttcccgtttacggtttaccctttaacccg

SEQ ID NO: 172292 - DNA, 600 bp, Homo sapiens
  misc_feature: GYAE6OF02GHHGI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtcctccagactttcagtctgtgactccgaaaggagaaagtcaccatccacctgccgggccagtcagagcgttggtagtagcttacactggtaccagcagaagccaggtcagtctccaaagctcctcatcaagtatcgcttcccagtccttctcgacgggtcccctgacggttcaggtggctagtggactcgtagggactactactttccaccctcaacctataccaaagtacgccgttacggaacgtctaggaagtatcgcttagacctaacgtttattacgtgtacactctacgtaactaccttaactttaccctactaacggttcgaaccttcgtaacccgtttacggaacccgtaacgggaccgtaaccggaacggtacgggtaactaaggttaaaaccgg

SEQ ID NO: 172293 - DNA, 548 bp, Homo sapiens
  misc_feature: GYAE6OF02IMD5S.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtcctccagtactttcagttctgtgactaccaaaggagaaagtcaccatcacctgccggccagtcagagcgttggtagtagcttacactggtaccagcagaagccaggtcagtcctccaaagcctcctcatcaagtatgccttccacttccttctacgacggggtcccctgaggttcagtggcagtggatcgtggacactactttcccaccctcacctacgtactaatacgacctaggaacgtctagaagatgctgactaacttactactgtacatacagtactaccttactttaccactagtctactcctacgttcgaccgaaggacacgacgtaggactaagttaaacgg

SEQ ID NO: 172294 - DNA, 829 bp, Homo sapiens
  misc_feature: GYAE6OF02JFQAS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtcctcaaagctcctcatcaagtatgcttcccgagttcccttctccgacggggttccccctacggacgggtttcagggtgggcctaggttgggaacttcggtaggggaacctaacgtaactttttcccgaaccccctttccaacccgtaacttaccgaaaactttacgggtaccccgttacggggtaaacgtaccgttaacggaaaacggtactacggccgttacggtaacccgttaaaaaccttttaacgttttaaccgtttcgggtttaaccctaaacgtttacccgtaaacgggtttaaacgtttaaacccgtttttaacccctttttaaacccgtaccggtttaaaacgggtttaccgtaaaccgttttccccgttaaaccccggttttaccgggaaccccggtaaaacccgggggtaaccgtaaccccgggtaaccgttaacggggtaaacggttaaaaccgtttaaaaaccggtaaacccggttacgggttaaccgggtacttaccgggaacctacccgttaacgtttcccgtaccgtttaccgtttaacccc

SEQ ID NO: 172295 - DNA, 592 bp, Homo sapiens
  misc_feature: GYAE6OF02H1LKZ.27.78.H01.1.454.CMB.1.raw
  modified_base (286)..(286): a, c, t, g, unknown or other
  misc_feature (286)..(286): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctnatcaagtatgcttcccagtccttctcgagggtcccctgaggtcagtgcagtgatctggacacatttcaccctcaccatcaactacgcctaggaacgtactggaagtagtcgctagactaacttattacttgtactatacgtaagtacgtaaccttactttacctactaagttgtaactccgtaacccttacgggacccgtaaacggggacctaaccggtacgtacggtaacgtaaacgtttaaaaccgaaccgttaggtacggccttacggaccgtaaccctattaccgttacggttcctttaccg

SEQ ID NO: 172296 - DNA, 530 bp, Homo sapiens
  misc_feature: GYAE6OF02FS9TU.27.78.H01.1.454.CMB.1.raw
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcaggtggatctgggacacatttcaccctcaccatcaatacgcctggaanctagaagatgctgcaacttattactgtcatcagtatactactttaccactagtnactctaccgttcggaccgtaagggaccacgacgtggacgtaattaaaccgacgtggtacggtctacgtccaccgtatctgttcttaccg

SEQ ID NO: 172297 - DNA, 553 bp, Homo sapiens
  misc_feature: GYAE6OF02JR5C2.27.78.H01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
  modified_base (378)..(378): a, c, t, g, unknown or other
  misc_feature (378)..(378): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccgggccagtcagagcgttggtagtagcttacactggtaccagcagaagccaggtcagtctaccaaagctcctcatcaagtatcgcttcccagtccttctcgacggtccctgagttcagtgcagtggatcgnggacactattaccaccctcaccatacaatcgaccgtaggaacgtctagaagagtcgctacgactaaactttcttactgtactatcgaagtacttacttacctttaccacgtaacgtctaactccgtacccgttacgaccgaacggtacaaccgtacgtacggacgtacgtaaacg

SEQ ID NO: 172298 - DNA, 608 bp, Homo sapiens
  misc_feature: GYAE6OF02G4TGN.27.78.H01.1.454.CMB.1.raw
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (411)..(411): a, c, t, g, unknown or other
  misc_feature (411)..(411): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctggccgggccagtcagagcgttggtagtagcttacactggtaccagcagaagccaggtcagtctccaaagcctacctnatacaagtntgccttcccagttcctctcgacggggtcccctggacggttcaggtcggactaggtcggactcgtgggacactactttccaccctcaccataccaatacgccctagggaaacncgtagaagtactgactgacctaactttagttactgtaccatcgaagtactaaccttaactttacctacgtaagtgtaactaccgtaccgttacccggaccgaaacgggaccaaccggtacgtacggaacgtaaacgttaaaccgtaacgtacggtacggtacgtacgacctaccgtaactccgtttagccctttacg

SEQ ID NO: 172299 - DNA, 606 bp, Homo sapiens
  misc_feature: GYAE6OF02IOAZI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagttagcttacactggtaccagcaagaacgccaggtcagtctaccgaaagcctcctcatcaaagttatcgtccttcccagttcccttcgtccggtaccggggtcccctacggtacggttccgaggttcggcgtaggtcggtaatccgtagggaactacgtactttccaaccctcaacctataccaatcgccgtaggaactcgagaagatgcgtagtacctaattacttactgtacatacgagtactaccttactttaccacgtaacgtatactcgtaccgttacggaccaaagggactaacgacgtaggtaacgtaacgttaaaccgagttacgtcggtactacgacctaccgtacgtcttcgtacttacg

SEQ ID NO: 172300 - DNA, 633 bp, Homo sapiens
  misc_feature: GYAE6OF02F645A.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggaccagcagaagccaggtcagtctccaaagctcctcatcaagtatgtccttcccagtccctttctccgtacggggtccccctcggtacggttcaggtggcaggtggatcgtgggacactactttcgacccctcgaccctactcaatacgccgtaggaacgcttagaagagtacgtctaggtactaacttaacgttattacccccgtataacgttccaaagtaacgtttaacccttaaccgttttaacctacgttaacgtagtaacctacctacccgttccggaaccgtaaacgggaccaacggtacgtacggtaaggtaacttaaaccggtaagtacggtcgtacgttcgacctaaccgtacgtaccgttacgttactttacccg

SEQ ID NO: 172301 - DNA, 571 bp, Homo sapiens
  misc_feature: GYAE6OF02H8G6X.27.78.H01.1.454.CMB.1.raw
  modified_base (145)..(145): a, c, t, g, unknown or other
  misc_feature (145)..(145): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtnaaattgtgctgactcagtctccagtactttccagtctgtcgactccaaaggagaaagtcaccatcacctgccggccagtcagagcgttaggtagtagcttacacgtcggtaccagcaagagccaggtcagtctacaaagctccnanctaagtatgccttcccncgttccttctccgacgggtccccctggtaggttcgaggtcggctagtggatcgtggactactacttccaccctacacctanacaatacgcgtaggacgactagagatgctcactaacttatactgtacatcagacttaaccttacttacctagagtacgacttccctaccttacggaccgaaagggaccacggtacgtaggaagtaacgttaaaccgtaggtggtccgtacgcgtacctacctacgtttcttcgtaccttccg

SEQ ID NO: 172302 - DNA, 575 bp, Homo sapiens
  misc_feature: GYAE6OF02GP4VZ.27.78.H01.1.454.CMB.1.raw
  modified_base (403)..(403): a, c, t, g, unknown or other
  misc_feature (403)..(403): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccgaggtcagtctccaaagctccgtcatacaagtatcgtcttcccagttcccttctccgtaccggggttcccctcggtacggtttcaggtcggctaggtggacttcgngggactactactttccaccctcaccatacaagtacgctaggaatctagaagatacgctagacctaacttacttactagtctataccgtagtacgttaccttacttacctatagttcacttccaccgttaccggacgaacggtacaccggtacgtacgagtaacgttaaacgg

SEQ ID NO: 172303 - DNA, 706 bp, Homo sapiens
  misc_feature: GYAE6OF02I4ZB5.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatggagcaaaactgacaagtcaaggcaggaagatgttgccatcacaactcattgggtttctgctgctctgggttccagcctccaggggtnaaattgtgctgactcagtctccagtctttcagtctgtacgactccgaaaggtagaaagtccaaccattccacctggccgggaccaaggtcaggagtcggttaggtagtagcctttaacgacgttcggtaaccaggccaaggaacgccgaggttcaggtcctaccgaaaagctccctcgaactaccaaggttactcgtcctttcccgagtaccttacctaccgaaccgggggttccccctacgggtaacggtttccgaacggttcgggacctacggttggggtaacctcggttcggggaacctacgtaacttttccgaaccctcaacccgtatactaacgtacgaccgtagaacgtctaggaacgtactcgctacgactaaaccgttataccgttagttcaattacgagttacgtaccgtttaaccttacgtcctaaagtcgtacttcgtaaccgttccggacgtaaacggcctacgtacggtaggtaacgtaacgttaaacggtaaccgtggtacggtacttcggaacctaccgtaacttactttcggtactttcccgg

SEQ ID NO: 172304 - DNA, 576 bp, Homo sapiens
  misc_feature: GYAE6OF02JYHEZ.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggtagtagcttacactggtaccagcagaagccaggtcagtctccaaagctcctcatcaagtatgcttcccagtccttctcacggggtcccctgacggttcagtggcagtggatcgtgggacacgtatttccaaccctcaccatcaatcgcctggaatctagaagatgctagactaacttagttactgtacattcagtacgttaccttactttacctacgtaagttcgacgtacctaccgttacggaccgtaaagggacctaacggaccgtagggtaacgtaacgtttaaaacgacgttaggtacgtaccttcggacctacccgtattaccgttcgtacccttacc

SEQ ID NO: 172305 - DNA, 567 bp, Homo sapiens
  misc_feature: GYAE6OF02JAVO3.27.78.H01.1.454.CMB.1.raw
  modified_base (296)..(296): a, c, t, g, unknown or other
  misc_feature (296)..(296): n is a, c, g, or t
  modified_base (463)..(463): a, c, t, g, unknown or other
  misc_feature (463)..(463): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctaccaaagctcctcatcaagtntcgccttcccagtccttctcgacggggtcccctcgtacggttcagtggcaggtggatcgtgggactactactttccaccctcaccctatacaatacgcctaggaacgctagaagtatgctgactaacttattactgtcatcaagtactacttactttaccataagtnactcctaccgttcgacgaacgggacacgacgtaggtaacgtaacgttaaaccgtaacgtggtacggtctaccggaccaacccgtattccttacgttccttaccg

SEQ ID NO: 172306 - DNA, 541 bp, Homo sapiens
  misc_feature: GYAE6OF02GT8TB.27.78.H01.1.454.CMB.1.raw
  modified_base (402)..(402): a, c, t, g, unknown or other
  misc_feature (402)..(402): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcctcccagtccttctcacgggtcccctcgacggttcagtggcagtggatcgtgggactctatttccaccctcaccctatcaaatacgcctaggaacgtctagaagntgctgactacgttatactgtcatcagtatacttacttacctactaagtcgatctaccgttcgaccgtaggtaccacgtacgtggaagtaacgttaaacgaacgtgtaccggtctacgtccaccgtatcgtcgtccttac

SEQ ID NO: 172307 - DNA, 563 bp, Homo sapiens
  misc_feature: GYAE6OF02GHCBR.27.78.H01.1.454.CMB.1.raw
  modified_base (229)..(229): a, c, t, g, unknown or other
  misc_feature (229)..(229): n is a, c, g, or t
  modified_base (450)..(450): a, c, t, g, unknown or other
  misc_feature (450)..(450): n is a, c, g, or t
  modified_base (507)..(507): a, c, t, g, unknown or other
  misc_feature (507)..(507): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtacagcagaagccaggtcagtctccaaagctcctcatcaagtatgccttcccagttcccttctccgacgggggttccccctcggtacggtttcaggttcggctaggtggactcgtggggacactatttccaccctcaccatcgaatagacctggaacgctagaacgntcggctgacctaactttattacctgtcaattctaagacgttaccttactttacctanaagtgactcgtaaccttcggacctaagggaccacgtactaggactagttaaaccgg

SEQ ID NO: 172308 - DNA, 588 bp, Homo sapiens
  misc_feature: GYAE6OF02IPXAJ.27.78.H01.1.454.CMB.1.raw
  modified_base (201)..(201): a, c, t, g, unknown or other
  misc_feature (201)..(201): n is a, c, g, or t
  modified_base (331)..(331): a, c, t, g, unknown or other
  misc_feature (331)..(331): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactaccaaagganaaagtcaccatcacctgccgggcagtcagagcgttggagtagcttacactggtaccagcagaagccaggtcagtctccaaagcctcctcatcaagtatgccttcccagtccttctcacggggtccctcgnggttcagtggcagtggatcgtgggacactattccaccctcaccatcaatacgcctaggaacgctagaagagtgctacgactaaacttattacctagtacattcaagtacgttaacttacctttaaccgtaaagtactacttaccaacccgtttccgggaaccaaagggacccacgtacgtgggtaacgtaagtttaaaaccgaacgttcggtacggtacctacgaccgtacctagttaccgttcggtcctttaaccg

SEQ ID NO: 172309 - DNA, 849 bp, Homo sapiens
  misc_feature: GYAE6OF02H1W6C.27.78.H01.1.454.CMB.1.raw
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagactttcagtctgtgactccaaagganaaagtcaccatcaccgtgcccggtcaagtcagacgtcgttggagtagtcttacacgtaggtaccagcgagaacgaccgtaggtcgagtcctaccaaacgtcctacctcaatactaagtactgtaccttccctacgttcccttacgtaccgtaccgggggttcccccttacggtacggttaccgtacgggttacgggtacccgtagggttacggaacgtttccgggttacggggtaaccttaacccgttaaccgttttttaccccgaaacccccctttacccgtaaaccccgttaaccttaccgtaaaaacggttaccggtaacccggttaaacggggtaaacggtacccgttaaagggaaaaccgggttaaggttaccgtaccggttaaccggtaacctttaaaaaccgttttaaccgttttaacccgttaccggttaaccctaacggttaaccctaaaggtaaaacccggttttaacccttttaaacccgtttacccgtttaaccggtaaacgttaaccggttaccgttacccgttaacccggtttaccggtaaccccggtaacgggaacccgtaaccggtaaccggtaacgggtaacgttaaaccgtttaaaacccggg

SEQ ID NO: 172310 - DNA, 530 bp, Homo sapiens
  misc_feature: GYAE6OF02FHEE8.27.78.H01.1.454.CMB.1.raw
  modified_base (148)..(148): a, c, t, g, unknown or other
  misc_feature (148)..(148): n is a, c, g, or t
  modified_base (156)..(156): a, c, t, g, unknown or other
  misc_feature (156)..(156): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtnaaattgtnctgactcagtctccagactttcagtctgtgactccaaagganaaagtcaccatcacctgccggccagtcagagcgttggatagcttacactggtaccagcagaagccaggtcagtctcaaagctctcagtcaagtatgcttcccagtccttctcgagggtcccctgacggttcagtgcagtggatctgggacacgtatttcaccctcacacgtcaatagcctgaacgctagaacgatgcttcgacaacttattactgtacatcagacgtactacttacctcaagttcgactcgtacctttacggcgtaacgggacacgactagggaacattaaaacggacttaggtggtcttcggacctacgtcttcgtgttcc

SEQ ID NO: 172311 - DNA, 714 bp, Homo sapiens
  misc_feature: GYAE6OF02HVKJ3.27.78.H01.1.454.CMB.1.raw
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtcctccagtactttcagtctgtgactccgaaaggagaaagtcaccatcacctgccgggccagtcagagcgttggtagtgcttacactggtacagcagaacgccaggtcagtcctacaaacgcctcctacactacaagtatcgtccttaccctacgttccttccgtccggaccggggttcccctcggtacggttcaggttcggcgtacggtggtagttcggtcgggactacttacttttacccaaccccttacctaacccgtaactactaaacgtaccgtccgtacgggtaacgtcgtaaggaaacggtagtcgtcgtacgtaccgttaactttacttaccttcggttaccacgttaccgtaacggtaacgttaaccgtttaaccttttaacccgtaacgttaaacgttacgtaaccttccgtaacccgttaccgggaaccgtaaacgggtaccgaccgtacggtacggtaaacggtaacgttaaacggtaacgtacggttacggtaccgtacggacctaacccgttacgttaccgttcggttacccttaccg

SEQ ID NO: 172312 - DNA, 677 bp, Homo sapiens
  misc_feature: GYAE6OF02HL3XP.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcaccgtgccgggccagtcagagcgttggtagtagcttacacgtggtaccagcagaagccaggtcagtctaccaaagtctcctcatcaagtatcgtccttccctagtcccttcgtaccgtacgggtcccctcggtacggttcgaggttcggctaggtgaacgttcgtacgggactacgtatttcccgaacccgtctaaccctacgtacaaacgttacgccgttagggaaacgtccgtaagaaacgtagtacgtctacgtaaccttaaacgtttaacttaaccgttgttaactaacgtacgtaacgtaacgttaaacctttaaccgttttaaccctacgtaaacgtacgtaacttcctaacccggtttaccggaacccgtaacgggtacaccgtacgtagggtaaactaacgttaaacgtacgttaggtcggtacgtacgaccgtaaccgtagttccgtagtttacccg

SEQ ID NO: 172313 - DNA, 678 bp, Homo sapiens
  misc_feature: GYAE6OF02JRX2C.27.78.H01.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccgaggggtgaaattgtgctgactcagtctccagtactttcagtctgtgactccaaagganaaagtcaccntccactcgccgggccagtacagcgtacgttggagtagcttacngtcggtacagcagacgcagtacncgtcaccaagctcncatcagtatctcctaccacgtccttctcgtaaccgggtccccttaggtacgttcgcggtaggcgtaggtgggtattacggtacggacctactacgtttcccaaccctcaaccctaactctaaacgtcgtacccgtagggtaacgacgtagtaacgatcgaacgtcgtaaacttaacctttacttactacgtttacgaacttacgtaagttaaccgtaaccgtttaaccctttaaccgtacgttaaacggttcgtaacccttaccggttaacccgttccggtaaacgggaaccggtactaaccggtaccggttagaacgttaaacgttaaccgttaacggcggttaagccgtacggaacccttagtaacctttggttaccttacttaccg

SEQ ID NO: 172314 - DNA, 554 bp, Homo sapiens
  misc_feature: GYAE6OF02GIDKL.27.78.H01.1.454.CMB.1.raw
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctgccggcagtcagagcgttggtagtagcttacactggtaccagcagaagccaggtcagtctccaaagctcctcatcaagtatgccttcccagttcccttctcgacgggtcccctgtacggttcagtgcagtggatcgtgggacacgtatttccaccctcaccatcaactacgcctaggaacgcgtagaagatcgctagctaaacttgttactgtactatcagaacgttacttaccttacctactaagtcgacttacctaccgttccggaccgaacgggacaaccggtacgtcggtactacgttaaaccgg

SEQ ID NO: 172315 - DNA, 531 bp, Homo sapiens
  misc_feature: GYAE6OF02GTBU0.27.78.H01.1.454.CMB.1.raw
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcggttaggtagtagcttacacgtggtaccagcagaagccaggtcagtctccaaagctcctcatcaagtatgcttcccagtccttctcgacgggtcccctcgaggttccagtggcagtggatcgngggacnctattcaccctcaccatacaatacgcctgaacgctagaagtatgctgacctaattatacttgtctatcagtagtacttacttacctanaagtnatacctacgttcgaccgaaggcacgtacgnggtaacgtaagtaaacgagtcggtagcgtagccactntctcgtcttaccg

SEQ ID NO: 172316 - DNA, 682 bp, Homo sapiens
  misc_feature: GYAE6OF02IH3ZT.27.78.H01.1.454.CMB.1.raw
  modified_base (191)..(191): a, c, t, g, unknown or other
  misc_feature (191)..(191): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttcagcctccaggggtgaattgtgctgactcagtctccagactttcagtctgtgactcaaaggngaaagtcacatcacctgccggccagtcagagcgttggtagtgcttacactggtaaccagcagaagccgaggtcagtctccaaagctcctcatccaaagttatcgtccttccctacgttcctttctccgtacggggttccccctcggtagggtttcaggttggctaggtggattcgtgggacctactacgttttccaccctccaacctagtaccaaagttacgcctagggaaacgcctaggaaagtatcgtactaggtacctaaacgttttaattaccttagttacctaacttcgtaaagggtacttaaacctttaccgttttaaacctacgtaaagttcgtaacttaccgtaacccgtttaccgggaccgtaaaacgggtacctaaccgggtaccgttagggtaacgttaaacgttaaaaccggtaacggttacggttacggtaccgttacgaccgttaaccgactttaccggttcggtacctttacccgg

SEQ ID NO: 172317 - DNA, 818 bp, Homo sapiens
  misc_feature: GYAE6OF02FZBOT.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggccagtcagagcgttggtagtagtcttacacgtggtaccagacgagaacgccgaggtcacgtcctaccaaacgcctcctactactacgaagtacttacgtccctttacccgacgtttccctttccgtaccggtaccggggttccccccgtacgggttaacgggtttccgtaagggtcgggtacgtagggttacggtaacgttccggtacggggtaaccctaacgttacgttttaccccgaacccccttacccaaaccctaaacgttaccctaaacgttaccggtacccgtaaggggtaaacggtaccgttaggaaaacggtacgttacggtaccgttacggtaacccttaaaactttttaacgtttaaccgttacgtttacctaacgttaaccgtaaaggtttaaccgtttaaaccttttaacccgttttaacccgttacgttaaacggttacggtaacctttacccgttaacccgtttacccgggaacccgtaacgggggaacctaccggtaacggtacgggtaaacgtaaacggtttaaaccggaacgtttcgggtacggtacctacggtaacccacgttactaccgttcgtttaccg

SEQ ID NO: 172318 - DNA, 681 bp, Homo sapiens
  misc_feature: GYAE6OF02JLUGL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccggcagtcagagcgttggtagtagcttacacgtggtaccagcagaacgccaggtcacgtctccaaagctcctcatacagtatcgccttcccagttccttcgtcgtaccggggtcccctaggtacggttcaggttcgacgtacgtggacttcggtaggactaacgtacttttccacccgttaccacctactaccaacgttacgccgttaggaacgtcgtaggaaacgtcgtacggtacttacgaaccttaaacgtttacttaaccttggtaacctagttaaccgtagttaactttaccctttaaaccgtttaccgtaactaacgtacgttaaccgttacccgttacccgtttaccgggaaccgtaaacgggtactaaccggtacgttacggaacgttaaacggttaaacgtaccggtcggttacgtcgtacgtaccgtaccgttactaccgttcgtttacttaacccgg

SEQ ID NO: 172319 - DNA, 612 bp, Homo sapiens
  misc_feature: GYAE6OF02IGZSJ.27.78.H01.1.454.CMB.1.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatccactgccggccagtcagagcgttggtagtagcttacactggtaccagcagaagccaggtcagtctccaaagctctcatcaagtatgcttcccagtccttctcacgggtccctcgngttcagtgcngtgatcgtgggacactatttccaccctcaccactactaatacgccgtaggaacgtctaggaagtactgtctacgacctaacgttttattaccgttgtacatactaagtacttaaccttaacctttaacctacgtaagtacgtacttacctaccgttaccggtaccgtaaacgggaccgaacggtacgtagggtaacggtaacgtttaaaccggtaaacgttcggttacggaccgttacggaccgtacccgtacgttacccgttacgttaccctttaccg

SEQ ID NO: 172320 - DNA, 596 bp, Homo sapiens
  misc_feature: GYAE6OF02GBIKO.27.78.H01.1.454.CMB.1.raw
  modified_base (179)..(179): a, c, t, g, unknown or other
  misc_feature (179)..(179): n is a, c, g, or t
  modified_base (230)..(230): a, c, t, g, unknown or other
  misc_feature (230)..(230): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgactccaaagganaaagtcaccatcacctgccggccagtcagagcgttggtagtagcttacactggtaccagcagaagccaggtcacgtctaccaaagctcctcatcaagtatgcttccagtccttctcacgggtccctgacggttcagtgcagtggatcgtgggacactactttccaccctcacctataccaaatcgacctaggaacgccgttaggaacgtatgacttcgacctaactttactttacttgtactaagttccaagtaacgttaaccttaccgttttacctacgtaacgttcgtaacttccctaacccgttaccggacccgtaaacggggtaccaaccggtaacgtacggtaacggtaattaaaacccgg

SEQ ID NO: 172321 - DNA, 667 bp, Homo sapiens
  misc_feature: GYAE6OF02JH1B5.27.78.H01.1.454.CMB.1.raw
tcagagcgtcgtctcacgaccggtgctcgatttagtgtgagtagtttgggtttgggggggcgatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcaccctgccgggccagtcagagcgttaggtagtagtcttacactggtaccagcaagaacgccaggtacacgtctaccaaacgtctcctcatacaagtactgtccttcccagtcccttctcgaccgggggttcccctcggtaggttccgaggtcggcgaggtcgggactcgtagggactactacttttaccacccgttccaacccgtaactacgtaaacgttaccggaccggttagggaaaccgtcgtaggtaaacgtacgttcgaccgtaggttaaccctaaacgtttaacgtttactacgttactaacgtaccgtaaggtaacttaaccgtttaaccgttacctacgtaagtacgtactaccgtacgttaccggaacgaggaccgacgtactcgggaacttaaattaaacggacgttggtacgtacgcgacctaccatttacgttcgttaccg

SEQ ID NO: 172322 - DNA, 525 bp, Homo sapiens
  misc_feature: GYAE6OF02H2VYL.27.78.H01.1.454.CMB.1.raw
  modified_base (385)..(385): a, c, t, g, unknown or other
  misc_feature (385)..(385): n is a, c, g, or t
  modified_base (446)..(446): a, c, t, g, unknown or other
  misc_feature (446)..(446): n is a, c, g, or t
  modified_base (481)..(481): a, c, t, g, unknown or other
  misc_feature (481)..(481): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggagtagcttacactggtaccagcagaagccaggtcagtctccaaagctcctcatcaagtatgctccagtccttctcgacggggtccctcgaggttcaggtcgcagtggatcgtggacactatttccaccctcaccatcaaatcgcctggaacnctagaagatgctagtactaactttatactgtacatctaagatacttacttaccactaagtnactcctacttcggacaagggaccacgacgtggaanaacgttaacgacgtgtcggtctgaccacctatctcgttcttacg

SEQ ID NO: 172323 - DNA, 664 bp, Homo sapiens
  misc_feature: GYAE6OF02GE5IV.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgctcccagtccttctcagggtcccctcgaggttcaggtgcagtggatcgtcgggacacgtactttccacccttcaaccctacgtaccaaactcgacccttgggaaacgtccgtaggaaacgacgttagactacggtactaaaccgtttactttaccgttacgtactaacgttcaacgtacgtttaaccttaaccttttacctaacgtaacggttagtaacgttaccgttaacccgttaccgggtacccggaaacgggaaccgtaaccgggtaccttacggggtaacgtaaaccggtttaaaaccggtacgtaacggtttacgggaccttcggaccctaaccgttactaccgtttacggtacctttaccc

SEQ ID NO: 172324 - DNA, 647 bp, Homo sapiens
  misc_feature: GYAE6OF02JGSXS.27.78.H01.1.454.CMB.1.raw
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcaccgtgccgggccagtcagagcgttggacgtagcttacactggtaccagcaggaagccaggtcagtccaacgaatccncctacatacgaagttncgtaccttccgtattccttcgtaccggttaccggtccctagtacggtcaggtcgacgtgtagcgttggacggactacgttccgttaccaccctactaccgtataaccgtaacgtcgtccggtaacggaacgtccgtaagaactgtcgtacgcgtaacttaacttacttgtactacgtactagacgttaccgttaccttacgttaccgtacgtacgagttacctaccgttaccgtacgggacctaaaggacccacgtaacgtacggtaacgttaaacgtaaccggtacggttacgccggtaacggtccgtaaccgtaccgttcgttacgttacgttacccgttacc

SEQ ID NO: 172325 - DNA, 591 bp, Homo sapiens
  misc_feature: GYAE6OF02JL7MF.27.78.H01.1.454.CMB.1.raw
  modified_base (199)..(199): a, c, t, g, unknown or other
  misc_feature (199)..(199): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
  modified_base (506)..(506): a, c, t, g, unknown or other
  misc_feature (506)..(506): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaattgtgctgactcagtctccagactttcagtctgtgactccgaaagganaaaagtccaccatccaccgtggcccgggccagtcgagagtcggttaggtagtgccttaacacgttcggtaaccagcaagaacgccaggtcagtctaccgaaagcctcctcagtacaacgtatcgtcccttcccgaggttcccttcgcgtaccggggttccccctggtaacggttccaggtgggcctaggtggacttcgngggaccctatcgtttccaacccgtcaacactacgaatcgcctaggaanctaagaagtctgctggacctaatttactacttgtacactgaactagtaccttacttaccncaagtgtactcctaccgttacggaccgaagggccaacggtcaaggtacaaagttaacagtgngtcncgctacnttctntcccgtc

SEQ ID NO: 172326 - DNA, 534 bp, Homo sapiens
  misc_feature: GYAE6OF02JZGIH.27.78.H01.1.454.CMB.1.raw
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaagtcaccatcacctgccgggccagtcagagcgttggtagtagcttacactggtaccagcagaagcaggtcagtctcaagctcctcatcaagtatgcttccagtccttctcacgggtcccctcgtaggttcagtgcagtggatcgtggacacgtatttcacctcaccatcaacgtacgcctggaactctagagatgctgactacttatactgtacatacagtacgtacttacttacctacaagttgactctaccgttacgccaaagggaccacggacgtaggaagaagttaaaccgacgtggtacgtcgtagtacccacctagttctcgtcttaccg

SEQ ID NO: 172327 - DNA, 541 bp, Homo sapiens
  misc_feature: GYAE6OF02JGR52.27.78.H01.1.454.CMB.1.raw
  modified_base (179)..(179): a, c, t, g, unknown or other
  misc_feature (179)..(179): n is a, c, g, or t
  modified_base (322)..(322): a, c, t, g, unknown or other
  misc_feature (322)..(322): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (492)..(492): a, c, t, g, unknown or other
  misc_feature (492)..(492): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaacgtcaccatccacctgccgggccagtcagagcgttggtagtagcttacactggtaccagcagaacgccaggtcagtctccaaagcctccnatcaagtatgcttcccagtccttctcgacggggtcccctgacggttcagtgcaggtggatcgtgggacacgtactttccacccctcaccactacaactacgcctggaagctagaagntgctgctaacttntactgtacatacagtacgttactactttacctactaagtnactcgtacccttcggaccgaaggaccacgacgtaggactagttaaacgg

SEQ ID NO: 172328 - DNA, 553 bp, Homo sapiens
  misc_feature: GYAE6OF02JWDAL.27.78.H01.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (469)..(469): a, c, t, g, unknown or other
  misc_feature (469)..(469): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagcctcctcatcaagtntcgccttccagtccttcncgacggggtcccctggtaggttcaggtcggacaggtcggatcggtgggactacgatttccaaccctnaccatcaatgacctggaacnctggaagatggctagactaattcgttatcgtacatacagtacgttacttacgttacctacgaagtntactccgtaaccgtcggaccgtaaggactacgacgtaggataacttaacgaacgtgtacgctacgacctacgtactcgtgttac

SEQ ID NO: 172329 - DNA, 744 bp, Homo sapiens
  misc_feature: GYAE6OF02GZNFS.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcacatcacctgccggccagtcagaggtcgttggtagtagacttacactggtaccagcagaagccaggtcagtcacaaagctcctacatacaagtatcgccttcccagttccttctcgacggggttcccctcggtacggttcaggtggacaggtcgtatcgtagggacacgtacttaccaccccgttcaaccctagttacctaaacgttacgacccgtacgggaaacgtacgttaacggaaacggtaacgtcggaacgttaccgaaccgttttaaaacgttttaactttacccgtttacggttaacctacgttaaccgttaaggtaaacgtttaacccgtttaaacccttttaaccccgttaacgttaaacgggttacgttaaccgtttacccttaaacccccggtttaccggaacccggttaaaccggggaaccctaccgggtaacgttaacggggtaaacgttaaacgtttaaaaccggtaaccgttaggtttacggaccgttacgaccgtaaccctaacgttccgttaccggttacc

SEQ ID NO: 172330 - DNA, 841 bp, Homo sapiens
  misc_feature: GYAE6OF02JSBTO.27.78.H01.1.454.CMB.1.raw
  modified_base (163)..(163): a, c, t, g, unknown or other
  misc_feature (163)..(163): n is a, c, g, or t
  modified_base (797)..(797): a, c, t, g, unknown or other
  misc_feature (797)..(797): n is a, c, g, or t
tcagagcgtcgtctcacgaccggtgctcgatttagtgtgagtagtttgggttgggggatcgagcaaaactgacgaaggtcctaaggccagggaagtactaggttcaccactctacgaactcattgggttctgctgcctcgtgggttctagcctccaggggtanaagttgtcggctggtactctagtctcctagacgtttcacgtctgtgacgtccgaaaggagaacgtcgaccgaattccgaaccgggtggcccgggtacgtacgtacgacgggggtactcggttggtacgtacgtcctttacgacgtacggttaacccagtccgaaggtaacgtcccgaaggttcctaaggttaccttaccgttaaaagccttaccttacgtaacgtttaccggaaacggttaccgtacgggtccccttttaccccggaaacgggttacccggtttccgttccggggtaaccgggggggtttcccccccttgggtaaccgggttttacaaccgggttggtaccgtaagggtttacgggaactttcgggtcggggaaactaacgtacgttttacccaaacccgttcgaaacccgattacgaaacgttacgggacccggtagggaacttacccgagtaaacggtcctacggtactacggtaactaaacgtttactaacggttacgttaccaacgttacgtaagtaacggttacgttaaacctttaccgaacgtaacgtcgtaacgtacctaccggttacggaacgtaaccgggtacacccggtagttacggtaacgttaacgttaaancggttagtacgtccgtcgtaccggtactacgtcgtagtcgttac

SEQ ID NO: 172331 - DNA, 684 bp, Homo sapiens
  misc_feature: GYAE6OF02JFS9D.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtcctccagtactttcagttctgtgactaccaaaggagaagtcaacatccacctcggccggccagtcagagcgttggtagtagcttacactggtaccagcagagcaggtcagtctaccgaaagctcctcatacaagttatcgtccttcccacgttcccttacgtcgaccggggtcccctcggaggttcgagtcggactaggtggactcgtacgggactactacgtttaccaccccgttcaaccctaagtacctaacgtacggtaccggtaggaaacgtcgttacgaaggtacgttccgtcgttacgtaacttaacgttttacgtttaccttaaggttacctaacgtacgtaaacggttaaccgttaaccttttaaccctttaccttaacgtaaggttcgtaaccttacccgtaacccgtttaccgggaaccccgtaacgggtaaccgtaaccggtaacggttacgggtaacgtaaactttaaacccggg

SEQ ID NO: 172332 - DNA, 573 bp, Homo sapiens
  misc_feature: GYAE6OF02I5CMD.27.78.H01.1.454.CMB.1.raw
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcaccgtgccgggccagtcagagcgttggtagtagcttacactcggtaccagcagaagccaggtcagtcctaccaaagcctcctcatcaagtatgccttcccagttccttctccgcggggtcccctcggtaggttcaggtcgcgtagtggctcgtagggacactacttccgaccctcacctatacaactcgcctaggactctacgaagntgctagctaacttnttactgtcactcgagtacttaacctactttaccgagtaagtctactcctaccgtaccgacgtaacgggaccacgtaccgttaggaagtacgttaaacgaaccgtcggtagaccttcggaccaccgtacttacgtccgttac

SEQ ID NO: 172333 - DNA, 638 bp, Homo sapiens
  misc_feature: GYAE6OF02HHOQG.27.78.H01.1.454.CMB.1.raw
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccaggggtgaaattgtgctgactcagtctccagactttcagtctgtgactccaaaggagaaagtcaccatcacctgccggccagtcagagcgttggtagtagcttacgactggtaccagcagaagccaggtcagtctcaaagctcctcatcaacgtatgcttcccagttcccttctcctagggttcccctcggaggtttcagtggctaggtcggatccgtagggactacgtactttccgacccttcgacctacttaccaaattacgcccttaggggaaactccgttaggaaacgattcggaccgttagaccgtaaacctttattaaccgtcgttacacgttcgaacggtacgttaaccttaccttttaaccctacgtaaagttcgaacttccgtaaccgtttccggacctaacggggacctacggtacgtacggtaacgtaactttaaacggaacgttcggtacgtcgtacgaccgtaacctacttaccgtcgttacccg

SEQ ID NO: 172334 - DNA, 757 bp, Homo sapiens
  misc_feature: GYAE6OF02JGW47.27.78.H01.1.454.CMB.1.raw
  modified_base (177)..(177): a, c, t, g, unknown or other
  misc_feature (177)..(177): n is a, c, g, or t
  modified_base (231)..(231): a, c, t, g, unknown or other
  misc_feature (231)..(231): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggtccagcctcgaggggtnaaattgtgctgactcacgtctccagtactttcagtctgtcgactaccaaagganaaagtcaccatccacctggccggccagtccagagtcgttaggtagtacgtcttacacgtcggtaccagcaaggaacgccagggtcacgtcctaacccgaaagcccttacctacaacttacaaacggttcgtaccgtccctttcccccaacggttttccccttaccggttaccggaaccggggtttcccccctagggttacgggtttaccgtaacgggttccgggtacgtaagggttccgggtacgtttccggtacggggtaactaccttacgtttacccgtacccgtaccctaacctaccgtaacgaacgttacccgaccgttaggaacgtccgtaacgtaacggtacgtcggtaccgttacgtaccttaaacctttacgttacgtacttaccgtaactacgtacgtaaaccgttacgttaacctttaccttaccggaacgttaccggaactttaccaacccggtttacccggaaccggtaacggtaccgtaacccgacggtaacggtacgtaaacggttaaaccg

SEQ ID NO: 172335 - DNA, 596 bp, Homo sapiens
  misc_feature: GYAE6OF02GNNX0.27.78.H01.1.454.CMB.1.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcaacaactcattgggtttctgctgctctgggttaccagcctcaggggtnaaattgtgctgactcagtctccagactttcagtctgtgactccaaaggnaaagtcaccatccacctgccgggccagtcagagcgttggtagtagcttacactggtaccagtcagaagccaggtcagtctaccaagtcctcctanactctaagtactcgtaccttacccagttccttacgtccggtaccggggttccccctaggtacggttacacgggtcggcgaggtcggacttcggtagggacctacgtactttccaccctacgaacctatacaataccgaccgtaggaacgcgtagagagtcgatacgtactaactttatactgtctatcagtactactactttacacgtagtcgtactaccgtaccgttacggaccgtaacggacctacgacgtacggtagtaacgttaaacg

SEQ ID NO: 172336 - DNA, 764 bp, Homo sapiens
  misc_feature: GYAE6OF02H9APD.27.78.H01.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcacancactgccggcagtcagagcgttaggagtagcttacacgttggtaccagacagaagccaggtcacgtctaccaaaacgcctcctacatacgaaagttatacgtccttacccgagtttcccttcgtccgtaaccggggttccccctcggttacgggtttccgaggtcgggctaggtggtacgtcggtaggggtaaccacgttacgttttacccaccccgttaccaaccctaataccaaaagtttacgtcccgtaagggaaacgtccgttaaggaacgtagttacgtcgtacgttaacctaacttttaacgtttaacgttacgttacctagtaccgttaagtaacgttaaccctttaaccgtttttaaaccacgttaaacgttacgtaaaccttaccccgttaaccgtttaccgggaaaccgtaaacggggtaaccgtaaccggttaaccggtaagggtaaccggttaaaacgttaaaacccggttaacggtacgggttacggtaccgttaacggaacctaaccccgttaaggttccctttacgggttacctttaaccccg

SEQ ID NO: 172337 - DNA, 576 bp, Homo sapiens
  misc_feature: GYAE6OF02HCMO9.27.78.H01.1.454.CMB.1.raw
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctacaaagctcctcatcaagtatgcttccagtcctctcgacgggtccctgaggttcagtggcagtggatcgtaggacacgtactttcaccctcaaccatacaatacgcctaggactntaggaagactgctcgactaattacttactcgtacatcaagtacgttaaccttactttacctactagtacgtaacttacctaccgttacggaccgtaacggaacgtacgtacgtaggtaacgtaacgttaaaccgaacgttggtacggtacttacgaccgtaaccgttacgtacttcgttaccttaccg

SEQ ID NO: 172338 - DNA, 604 bp, Homo sapiens
  misc_feature: GYAE6OF02G3WX4.27.78.H01.1.454.CMB.1.raw
tcagagcgtcgtctcacgaccggtgctcgatttagtgtgagtagtttgggtttggggatccttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacactcggtaccagcagaacgccgagggtcagtcctaccaaagcctcctcatcaagtatgccttccacgttccttctacgccggggttcccctggtacggttcaggtgcaggtggactcgtggacactactttccaccctcaacctatacaactacgccgtaggaacgtctaggaacgtatcgactacgtactaactttacttacgttcgtactacttactacgttaacgttacctttacctttacctacgtaagtctaactcccgttaccgttaccggaccgaacgggtaccacgtaaccggtacgggaactaacggttaaaccg

SEQ ID NO: 172339 - DNA, 762 bp, Homo sapiens
  misc_feature: GYAE6OF02G6VQS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccggccagtcagagcgttggtagtagcttacactggtaccagcagaagccaggtcagtctccaaagctcctcatcaagtatgcttccctagtccttcgtcgtacgggtcccctgtacggttcaggtggcacggtggactcgtgggactacgtactttcacccgtcctaaccgactaccgtaacgtaacgtcccgtaggaacgccgttaaggaaagtacgtacgtaccgttacggtaaccttaaacgtttaacttaaccggttacgttaccgtaacgttaccgtaaacggttaaccggtttaaaccgtttaacccgttttaaacccttaccgttaaacggtttaccgttaaacctttacccgtaaaccccggtttttacccgggaaaccccggttaaaccgggggtaaacccgaaccgggttaccgttaaccggggtaaacggttaaacggttaaaacccggtaaaccgggtttcccggtaagggtacccgtttacggaacccgttaacccgttaagtttcccggttacgtttacccggttttaacccc

SEQ ID NO: 172340 - DNA, 539 bp, Homo sapiens
  misc_feature: GYAE6OF02F2QTH.27.78.H01.1.454.CMB.1.raw
  modified_base (452)..(452): a, c, t, g, unknown or other
  misc_feature (452)..(452): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcactgccgggccagtcagagcgttggtagtagcttacactggtaccagcagaagccaggtcagtctccaaagctcctcatacaagtatgccttcccagtccttctcgacggggtcccctcggaggttcaggtggcaggtggatcgtgggacactatttccaccctcacctataccaatacgccgtaggaatctagaagtatgctgactaacttattactgtacatcagtacgttactactttaccntaacgtgactccaccgttcggacgaaggacacgacgaggacgtaacttaacgacgtgtacgacgtcgccaactactctgtccttacg

SEQ ID NO: 172341 - DNA, 630 bp, Homo sapiens
  misc_feature: GYAE6OF02IY0GH.27.78.H01.1.454.CMB.1.raw
  modified_base (287)..(287): a, c, t, g, unknown or other
  misc_feature (287)..(287): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagcttacactggtaccagcagaagccaggtcagtctacgaagctcctnatacaagtatcgccttccagtccttcacgacgggttcccctggtacggttcaggtcggactaggtcggtaactcgtagggactactacgtttacccacccttccaacctagtacaaagtcgccgtaggaacgctagaagatgactagactaacgttacttacgtgtactacgtacaacgtaacgttaccttaaccgtttacctaagtaacgtacgtaaccttaccgtacccgttaccgggaaccgtaaacggggtaaccaccgtaacgtacggtaaagtaaaccgtttaaacgtaacgttacggtacgtactacggtacccacgttacttaccgtcgtttacc

SEQ ID NO: 172342 - DNA, 565 bp, Homo sapiens
  misc_feature: GYAE6OF02H505G.27.78.H01.1.454.CMB.1.raw
  modified_base (321)..(321): a, c, t, g, unknown or other
  misc_feature (321)..(321): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagacagaagccagtcagtactacaaagctacctnatcaagtatgccttccacgttccttctcgacggtcccctgacggttcagtgcagtgatcgtggactactatttccacccgtacaacactacaaactacgacgtaggaaactccgtagtaaacgtatcgactacgactaaacgtttatactgtacctatacaagtacgttacttaacttaccctacaagtgacttctaacttccggactaacgggacacggtaccgtaggtacaagttaaaccgg

SEQ ID NO: 172343 - DNA, 569 bp, Homo sapiens
  misc_feature: GYAE6OF02HIV0A.27.78.H01.1.454.CMB.1.raw
  modified_base (229)..(229): a, c, t, g, unknown or other
  misc_feature (229)..(229): n is a, c, g, or t
  modified_base (375)..(375): a, c, t, g, unknown or other
  misc_feature (375)..(375): n is a, c, g, or t
  modified_base (421)..(421): a, c, t, g, unknown or other
  misc_feature (421)..(421): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctaccaaagcctcctcatcaagtatcgcttccagtcctctcgacggggtccctgtagtcagtgcaggtgntcgtgggacactatttccaccctcaccatcaatacgcctaggaacnctagaatagtgctgacctaacttacttaacgtgtacacttacgacgtacgttaccttacctttaccctacgtaagtctaacgtacctacccgttacgggacccgtaacgggacccaacggtacgtacggtacgtaacgttaaaaccgg

SEQ ID NO: 172344 - DNA, 778 bp, Homo sapiens
  misc_feature: GYAE6OF02JO4W7.27.78.H01.1.454.CMB.1.raw
  modified_base (191)..(191): a, c, t, g, unknown or other
  misc_feature (191)..(191): n is a, c, g, or t
  modified_base (384)..(384): a, c, t, g, unknown or other
  misc_feature (384)..(384): n is a, c, g, or t
  modified_base (546)..(546): a, c, t, g, unknown or other
  misc_feature (546)..(546): n is a, c, g, or t
  modified_base (752)..(752): a, c, t, g, unknown or other
  misc_feature (752)..(752): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaattgtcgctagctgagtcctccagttacttctagtctgtanaccctaacgaaaggaagtaaacgtccaaccgactaccaccggtccgggacccgggaccctaggtacaacgggacggttcgggtttacggttaaggtacgttacctttaaccgaccggtttacgggaccccaaggctaaacggaaacgccccggtaggtcctaacgttccctaaacgaaacgtccttcacgtanaacggttaatcttccgtcccctaccggtactttccgttctaccggggtacccgggttacccctcggtttagggttacagggttccggtacgaggttagtaccggtcggtaaacggacctttacttacccttttcccgaacccctacgtaacctacggttaanaaaccgtttacggacccggacggttaacgtacggtaacgtaaacgtacgtaccgtacgtaccgtaatttaaccttttaagtccgttagtcgtaaacctggtaacttacgttaccgtttaaccttactacgtagggtcctactacgtaccgttaccgggacgtaacggctaccgaggtagaacgttaacgtaacgttagtcgtacgngaaccgccagtccgtcttacacgttc

SEQ ID NO: 172345 - DNA, 539 bp, Homo sapiens
  misc_feature: GYAE6OF02GWMOU.27.78.H01.1.454.CMB.1.raw
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgacgttcaggtgcagtggatcgtggacacatttccaccctcaccatcaatacgcctggaacnctgaaagatgctaggactaaccttattacctgtcatcaagtacgttacttacctttacctctaagtnactctaccgttcgaccaaggtacacgacgtaggaacgtaacttaaacgacgttggtacgcctgacctaccatcttacgtcttaccg

SEQ ID NO: 172346 - DNA, 516 bp, Homo sapiens
  misc_feature: GYAE6OF02FSBLZ.27.78.H01.1.454.CMB.1.raw
  modified_base (310)..(310): a, c, t, g, unknown or other
  misc_feature (310)..(310): n is a, c, g, or t
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctcaaagctcctcatcaagtatgcttcccagtccttcncgacgggtccctgagttcagtggcagtgatcgtgggacactatttccaccctcacctataccaatcgcctggaaacgctaggaanagtgctgactaacttattacttgctatcagtatactactttacntaagtgatctacgttcgacaaggacacgagtggagtaacttaacgaccgtgtacgctcgcacctatcttcgtcttac

SEQ ID NO: 172347 - DNA, 612 bp, Homo sapiens
  misc_feature: GYAE6OF02I4ODJ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactacaaaggagaaagtcaccatcacctggccgggccagtcagagcggttggtagtagcttacactggtacagcagaagccgaggtcagtacctaccaaacgcctcctcatcaagtatcgtcttcccacgttcccttctccgaccggggtcccctcggtacggttcgacgtggacgaggtcggctcgtgggaccacgtactttaccaccctacaccatacaatacgccgtaggaacgctagaagacgtgcgtagacttaacgtttacttacgtcgtactactacgtacgtacgttacttacctttacctaacgtaacgtacgtacttaccgtacccgttaccggaacgtaacgggtaccgtaacgacgtacggtaacgtaacgttaaacccgg

SEQ ID NO: 172348 - DNA, 652 bp, Homo sapiens
  misc_feature: GYAE6OF02IRB65.27.78.H01.1.454.CMB.1.raw
  modified_base (294)..(294): a, c, t, g, unknown or other
  misc_feature (294)..(294): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccgaaaggagaaagtcaccatcacctgccgggccagtcagagcgttggtagtagcttacactggtaccagcagagccaggtcagtctaccaaagctcctcatcaagtntacgtcctcccagtccttcgtcgaccgggtcccctcgtacggttcacgtggctagtggatcgtggactactctttaccacctacacctatacaacgtacgcgtaggaacgtcgtagaacgtagtacgctgaccttaacttatttaactcgtactacgtacaagtaccgttactttaaccttaccttacgaagttcgtacttaccgtaacccgtttaccgggaaccgtaaaacgggtacctaacggtacccggtaagggtaacgttaaaccgttaaaaccggtaaccggttacggtacgggttaacccgtacgtacccgttaacccgtacgttttaccgttacggttccctttaacccg

SEQ ID NO: 172349 - DNA, 828 bp, Homo sapiens
  misc_feature: GYAE6OF02GKU7Y.27.78.H01.1.454.CMB.1.raw
  modified_base (263)..(263): a, c, t, g, unknown or other
  misc_feature (263)..(263): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaattgtgctgactcagtcctccagtactttcagtctgtcgactccaaaggagaagtcaccatcaccgtgccggccagtcagancgttgtagtagtcttacacgtggtaccagacagaacgccgtaggtcctaggtacctacccgaaaaggccttacccgtacacgttaccaaaggttactagtaccctttaccccaggtttacccctttacgtttaccggaaccgggggtttcccccctacgggttaacggttttccggaaacggttcggggtacctacgggttaccgggtacttccgggttacggggtaacctaaaccggtttacttttacccccgaaccccgtaccctaacccgttactaacctaaacgtaccggtacccgttaggggtaaacgtccgtaaggtaaacggaacgttcgggtacttacgggtaacctaaaccgttttaagtttaccgttaccggttaccacgtttaaccgaaggttaaaccgttaccgtttaacccgttttacccgtaccgttaacggtttaacggttaccgttaaccccgttaaccccggtttacccgggaaccccggtaaagggtaaccccggaaacccgggttaaccggtacggggtaaaccgttaacggtttaaaaacccggg

SEQ ID NO: 172350 - DNA, 566 bp, Homo sapiens
  misc_feature: GYAE6OF02GWMCK.27.78.H01.1.454.CMB.1.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (397)..(397): a, c, t, g, unknown or other
  misc_feature (397)..(397): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaaccagcagaagccaggtcagtcnccaaagctaccncatcaagtatgcttcccagtccttctcacggggtcccctgaggttcagtggcaggtgatcgtgggacactattcaccctcaccatacaatagcctaggaacgctagaagntcgctagactaacttattactgtacatcaagtagtacttacttacctactaagtcgtactacctacgttcggaccaaacgggacctacggactagggaacgtaacttaaaccgtaacgttaggtaccggtacgtacgtaccaaccgtatccgttacggttacttacccg

SEQ ID NO: 172351 - DNA, 678 bp, Homo sapiens
  misc_feature: GYAE6OF02IODPU.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtgcttacactggtaccagcagagccaggtcagtcaccaagctctcatcaagtatcgccttccagtccttctcgacggggtcccctgacggtttcagttcgggactacgggtacgtacgttccggagggaaccttaacgtaacgttttccccaaccccttcgaacccctaagttacaaaacgttccggtaccgtagggtaacgaccggttaaggaaacgtagtcgtcgtaacggtacctaaactttaacttacgtacgttactactacgtacgtacgttaacctttaacttaccgttaactaacgtacgtacttaccgtaaccgttaccgaaccgtaaaggggtaaccacggtaaacgttagggaaacgttaaacgtaaacgtaaacgggttcgtaacggaccttacgacccgttacaaccgtttaccgttggttaccc

SEQ ID NO: 172352 - DNA, 660 bp, Homo sapiens
  misc_feature: GYAE6OF02GIZX4.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtcagagcggttggtagtagcttacactggtaccagcagaagccaggtcagtctccaaagctcctcatcaagtatgccttcccagtccttctcgacgggtcccctcggagttcagtggcagtggatcgtgggacacgtactttccaccctacaccataccaacttacgccgtagggaacgtcgtagaagtagtagctgaaccttaacttacgtttacttcgtactatacaacgtacgtttaaccttaaccttttaaccctacgtaacgttacgtacttaccgtaacccgttttaccggaacccggtaaacgggaaccgaaccggtacggtaacgggtaacggttaaaacgtttaaaacccgggtaaccgttcggttaacggtccggttacgtaacccgtaacccgttagtcccgtttacgtttaccccgtttaacccg

SEQ ID NO: 172353 - DNA, 716 bp, Homo sapiens
  misc_feature: GYAE6OF02IB25F.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctggggttccagcctccgaggggtgaaattgtgctgactcagtctccagactttcagtctgtgactccaaaaggagaaagtcacatcacctggccggccagtcagagcgttggtagtagcttacactggtaccagacagaagccgaggtcagtctaccaaagctcctacatacaagtatcgtcttcccacgttccttctcgacgggttccccctggtacggttcaggtcggcaggtgacgtcgtcgggactactactttaccaccctaccaacctactactaaactccggtactaggaaacgcgttagaagagttcgactagactaaacgttattacgtgtacgaactcgtaacgtaacgttaacctttaaaccctttaacctaacgtaaacgttagtaacgttacccgttaacccgtttaaccggggaacccgttaaaacggggacccgttaaccggtaacggttacggggtaaaaacgttaaaccggtttaaaaacccgggttaaaccggttacggttacccgggtaaccggttacccgggtaaccctaaacccgtttaaaccgttccgtttaaccggttttccccgg

SEQ ID NO: 172354 - DNA, 577 bp, Homo sapiens
  misc_feature: GYAE6OF02HRXDT.27.78.H01.1.454.CMB.1.raw
  modified_base (405)..(405): a, c, t, g, unknown or other
  misc_feature (405)..(405): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtgaaattgtgctgactcagtctccagactttcagtctgtgactccaaaggagaagtcaccatcacctgccgggccagtcagagcgttggtagtagcttacacgtggtaccagcagaagccaggtcagtctccaaagctcctcatcaagtatgcttcccagtccttctcgacgggtcccctcgtaggttcagtcggcaggtggatcgtgggcactattccgaccctcacactcaatacgaccgtaggacgcgtagaagatcgngtcgactaacttatacttgtactatacgagtactaccttaacttacctactaacgtactactacctaccgttaccggaccgaacggaacgacgacgtacggaacgtaacgttaaaccgtaacggtggtacggtaccgtacgacccgaacctactcgttcgttaccttacccg

SEQ ID NO: 172355 - DNA, 606 bp, Homo sapiens
  misc_feature: GYAE6OF02J082W.27.78.H01.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcagggtgaaattgtgctgactcagtctccagtactttcagtctgtgactccgaaagganaaagtcaccatccaccgtgccggccagtcagacgcgttggtatagcttacgacgtcggtaccagacagaacgccaggtcaacgtctaccaaagcctacctcatcaagtatcgccttccagtccttcgcgacgggtcccctgtacggttcaggtgacgacgtggactcgagggacactagttccaccctcacctataccaagtacgccgtaggaactcgtagaacgtagtgctacgactaaacgttnttaacgtcgtactactacgataacgttaccttacctttaacctcgtaaacgtcgtacgtaccctaccgttccggaaccgaacgggttaccacgtacgttacggaaacgttacgttaaacgaacgttgacggtactacggacaccgtacgtacttcgttaccg

SEQ ID NO: 172356 - DNA, 707 bp, Homo sapiens
  misc_feature: GYAE6OF02G72RY.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagttctgtgactaccaaaggagaaacgtcaccataccacctcggccgggcagtccagagcgttggtagtagcttacactggtaccagcagaagccaggtcagtctccaaagcctcctcactcaagtatgccttcccagttcccttcctcgtacggggttcccctcggtaacggtttccgtaggtcggacgtaggtacggtacgtccggttacggggacctaaccgtacgttttaccccaacccccgtacctaaccctataccgtaaacgtacgtcccttagggaaacgtccgtaggaaacgtcgtacgtcctaggtacctaaacttttactaaccttcgtaactacgttacgaacgttaacgttaacccttaaccttttaccgtaacgttaacggtacgttaaccgtaccgttaacccgttacccgggtaaccgtaaaccgggaccgtaacccggtaaccggttacgggtaaaccggttaatttaaaaaccccggg

SEQ ID NO: 172357 - DNA, 591 bp, Homo sapiens
  misc_feature: GYAE6OF02F44L6.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcgtacggggtcccctcggtaggttccagtcggcaggtggatcgtgggacacgtatttccaccctcaccataccaatacgcctaggaacgtcctaggaaagtatgctcgtactaactttattactgtacatccagagttaccttacctttaccacgtaagtacgacttaccgtacccttcgggaccgtaaacgggacctacgtacgtaggtaaacgaacgtttaaaccggaacgtgttaggccgttacgacctaaccgtacttccgttgtttacccg

SEQ ID NO: 172358 - DNA, 696 bp, Homo sapiens
  misc_feature: GYAE6OF02IVHB2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacacgtcggtaccagcaagaacgccaggtcagtctaccaaagcctcctcatacaagtatcgtccttcccacgtccctttctccggtaaccggggttccccctacggtacggttctaagggtcggtccgtaaggtcggattcgtcggggaacctacgtaactttccaccccgtcaaccctataccctaatacgtccgtacggtaacgtccgtaagaagtacgtggtactacgaacctaaccgtttacttacgtcgttacctacgttacgaacgttacgttaacctttaccctttaaccgtacgtaaggttactaccgtaccgtaccgtttaccgggaaccgtaaaccgggaccgtaacggtacgttaacgggtacgtaaaacggttaaaccggtaactcgggtacgtaccgttagacccgtaacccgtagtaccgtttacgttaccgttaccc

SEQ ID NO: 172359 - DNA, 553 bp, Homo sapiens
  misc_feature: GYAE6OF02GH7KO.27.78.H01.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggngaaagtcaccatcacctgccgggccagtcagagcgttggtagtagcttacactggtaccagcagaagccaggtcagtctccaaagctcctcatcaagtangccttcccagtccttctcgacggggtcccctggtacggttcagtcggcaggtggatcgtgggacacgtatttccaccctcaccatacaatacgcctaggaacgtctagaagatgtctgacctaacttattacttcgtactatcagtagttacttactttacctactaagtgtactcctaccgttccgaccgaaggaccacgacgtaggaacgtaattaaacgagtagtcggctgacctaccatcgtacgtcttaccg

SEQ ID NO: 172360 - DNA, 569 bp, Homo sapiens
  misc_feature: GYAE6OF02F7QO9.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggttaaattgtgctgactcagtctccagactttcagtctgtgactccaaaggagaaagtcaccatcacctgcccgggccagtcagagcgttggtagtagcttacactggtaccagcagaagccaggtcagtctaccaaagctcctcatcaagtatgccttcccagttccttctcgacggggttccccctcggtacggttcaggtcggactaggtggatcgtgggacactactttccaccctcaccatcaatacgcctggaacgctagaagatgctgactaacttattactgtcagtcaagtacgttaaccttaccttacctagtaacgtcgtaactcctaaccgttccggaccgtaagggaccacggtaccgtaggaacgtaataacgtaacgg

SEQ ID NO: 172361 - DNA, 642 bp, Homo sapiens
  misc_feature: GYAE6OF02GP4CS.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcaccgtgccgggccagtcagagcgttggtagtagcttacacgtggtaccagcagaacgccgaggtcacgtctaccaaagcctcctcatacaagtatcgccttcccacgttcccttctccgtaccggggtcccctcggtaggttcaggtggacaggtggatcgtagggaccacttactttccacccctacacctactactaagtacgaccgtagggaacgtcgtaagaaggtatcgtctacgtacctaaacttttacttaccgttgtacctaactacgtaacggtaattacctttaacctttaccctactaacggttacgtaacgttccctaaccggtttacccggaaccgtaacggggaacctaaccggacggtaacggtaacgttaacgttaaaacgg

SEQ ID NO: 172362 - DNA, 732 bp, Homo sapiens
  misc_feature: GYAE6OF02HUAJS.27.78.H01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagccctccgaggggtgaaattgtgctgactcagtcctccagtactttcagtctgtgactaccgaaaaggngaaacgtcaccatccaccgtcgccgggccagtcagagcgttggtagtagtcttaactactggtaccagcaagaacgccaggtcagtctacaagcctctacatacaagtatcgtccttcctacgttcccttcgccgtaccggggttccctcggtaaggttccgaacggtcggtacagggtcggtaagtccgtaggggactacgtacctttcccgacccctaccgaacctataacctaaacgtaccggtacctaacgggaaacgtccgtaaggtaaacgagtcggtacctacgtaaccttaaaaccgttttcgttaacgttacgtaaccttaacgtacgtaaacggtaaacgtttaacccgtttaacccgttttaaccgtaacgttaaggttaacgtaacccttaccgtaaacccccggtttaccgggaaacccgtaaacgggggtaaaccctaaccggtaaccggtaaagggtaccgtaaaaacggtttaaaacccgg

SEQ ID NO: 172363 - DNA, 542 bp, Homo sapiens
  misc_feature: GYAE6OF02FZ2CJ.27.78.H01.1.454.CMB.1.raw
tcagagcgtcgtctcacgaccggtgctcgatttagtgtgagtagtttgggtttggggatcttaaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtgcagtggatcgtgggacactatttccaccctcacccatcaaactacgcctaggaagcgtagaagactgctagactaacttacttactgtacatcgaagacttacctactttaccactaagtgactccgtaccttcggaccgaagggccaacgacgtaggacgtaagtaaaccg

SEQ ID NO: 172364 - DNA, 621 bp, Homo sapiens
  misc_feature: GYAE6OF02H5L5A.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgctaccaaaggtagaaagtcacatcacctgccggcagtcagagtcgttggtagtagtctacacgtggtacagacaagaacgcgaggtacagtacgtacaaacgcctcctactatactaagtactcgtacctcctacgttcctcgtacgtccgggtccctacggtacggttcgaggtggacgtaggtcggtatcggtaggactactacttaccaccctacaactataccaatacgtccgtaggaacgtctaggaaacgcgtagcgtagaacctaatttactacgtcttactagtacgtaagtactaaccttacgttactacgtagtactactaccgtaccggttacgacgaacggtaccagtacgtacggtaaggtaaacttaaacggtgtacggttacgaccgtcgaacctaccgttacgttctacgttctacccg

SEQ ID NO: 172365 - DNA, 805 bp, Homo sapiens
  misc_feature: GYAE6OF02INYPV.27.78.H01.1.454.CMB.1.raw
tcagagcgtcgtctcacgaccggtgctcgattttagtgtgagtagtttgggtttgggggtagtgagcaaaaacgtgacaagtcaaggcacggaagatgttgccatcgacaactcattgggtttctgctgctctgggttccagcctccaggggtgaaattgtgctgactcagtctccagtactttcagtctgtgactaccaaaggagaaagtcacatcaccgtgccggccagtcagagtcgttaggtagtagcttacacgtcggtaccagcaagacgccaggtcagtcctaccgaaagtcctcctacactacgtaagtactcgtccttacccgtacgtttcctttccgtacggtacccggggttccccgtacggtacggttcgaggtcggcgtaggtaggtacgtcggtacgggaacctaacgtacttttaccacccgttaccaacctacttaccgaaacgttaccggtaccgtacgggtaacgtcgtaaacgggtaaacgtacgtacggtaccgtacggtaaaccttttaacgttttaacctttaacgttcgttaaccgttaacttaaccggttaacgttaacgtttaaacccgttttaaccctttaaccgttaacggtaacggtttacttaaccggttacccttaacccgggttaccgggtaaacccggtaaacgggtaaccgttaacccggtacggttaacgggtaacggttaaaaccggttaaaccggacggttcgggtaaccggtcgtaaccgtacccgtaccgttaaccgtttccggtttaccgttaccctttaacccgg

SEQ ID NO: 172366 - DNA, 689 bp, Homo sapiens
  misc_feature: GYAE6OF02JMLMF.27.78.H01.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (392)..(392): a, c, t, g, unknown or other
  misc_feature (392)..(392): n is a, c, g, or t
  modified_base (490)..(490): a, c, t, g, unknown or other
  misc_feature (490)..(490): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtgaaacttgtgctgactcagtctccagctttcagtcctgtcgactccaaaggngaaagtcacccatcacctgccggccagtcaagngcggttagagtagcttacactgggtaaccagcgagaacggccacgggttcacgtcgtacccaaagcctcctacactccaagtactgacctttcccaacgttccttcctcggtacgggttccccctcgtacggtttccaggtcgtcaaggtcgagttccgngggtaaccactacgtttccaccctacgtacccatacccaatacggcctacggaatcgagtaagtatagactcgacttaaaccttggttaactcgttanagtttaccgaagttactaaccgttactttaaaccgtaccctaagtttgaaaccgttcctaacccttttacggggaacctaaaccggggtacctaaccggtactcggggttaaagttaaaccggttaaaacgtaaaccggtggttaaccggtccgtaaacggttccaacccgtttactaccggtttctaccctttaccgg

SEQ ID NO: 172367 - DNA, 710 bp, Homo sapiens
  misc_feature: GYAE6OF02J25SD.27.78.H01.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagagcgtcgtctcacgaccggtgctcgatttagtgtgagtagtttgggtttggggggtcgatgagcaaaactgacaagtcaaggcaggaagatgttgccatcacaactcattggtttctgctgctctgggttccagcctccaggggtgaaattgtgctgactcagtctccagtacctttcagtcctgtgactaccaaaggagaaagtcaccatcacctggaccggccagtcagagtcggttagtacgtagcttaaccgacgtggtaccagcagtaagccgaggtcagtcctaccgaaacgcttcccncgtaanctaacgtagtcnccttccctacgtccttaccttaccggacgggttccccctggtaccggttgtacgggtcgtcgacgttcgggaacttcgtacgggtaactactaacctttcccgaacccttccaaccctactactacgttaaccgccgtacggaacgtccgtaacgtaacggattccggacgtaccgtaccgttaaacgtttaacgtttaacccttagtaaccgttaacgtaccgtaagtacccgtttaaacctttaccgtttaaaccctaccgtaaacggtcttaacgttaccctaaccgtacccggtacgaacgggtaccgtaccgtaagtaccggaagtaacgtaaaacggtctacggttagaccttcggacctacgtacgtctcttaccg

SEQ ID NO: 172368 - DNA, 582 bp, Homo sapiens
  misc_feature: GYAE6OF02HNAAR.27.78.H01.1.454.CMB.1.raw
  modified_base (351)..(351): a, c, t, g, unknown or other
  misc_feature (351)..(351): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacgggtcccctcgaggttcagtgcagtgatctgggacanactttcaccctcaccatcaatcgctggaagctgaacgatgctgactaaacttattactgtacattcgaacgtagttaaccttactttaacctactaaacgtgtactacccgtaccgtttccgggaaccaaacggggtaccaaccggtacgttagggaacggtaactttaaaaccggaacgttcggtacggccgttacgtccgaaccgttattcgttacgttcctttaaccg

SEQ ID NO: 172369 - DNA, 562 bp, Homo sapiens
  misc_feature: GYAE6OF02IQC4Z.27.78.H01.1.454.CMB.1.raw
  modified_base (409)..(409): a, c, t, g, unknown or other
  misc_feature (409)..(409): n is a, c, g, or t
  modified_base (473)..(473): a, c, t, g, unknown or other
  misc_feature (473)..(473): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccggccagtcagagcggttggtagtagacttacactggtaccagcagaacgccaggtcagtctccaaagctcctcatcaagtatgccttccagtccttctcgacgggttccccctgtcggttcaggtggcgtagtgagtcgtgggacacgtactttccaccctcaccactacaatacgccgtaggacactagaaagntacgctacgactaactttacttacgtactacgtatacgagtactaaccttacttcctataagtnactacgtaccgttacggaccaaacggtacaacggtacgtaggtaacgtaattaaacgagtcgtaggctacgactactatctactcttac

SEQ ID NO: 172370 - DNA, 582 bp, Homo sapiens
  misc_feature: GYAE6OF02F4X2V.27.78.H01.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactcaaaggnaaagtcacatcacctgccggcagtcagagcgttggagtagcttacgactggtaccagcagaagccaggtcagtctaccaaagcctcctcatacaagtatgccttcccgagtccttcgtcgtacggggttcccctggacggttcaggtggacagtggatcgtgggactactacgtttcaccctcacctatacactcgccgtaggaagctagaagtatggctgtactaacttattactcgtactatacgtagtacgttaacttacctttaacctagtaagtcgtacttacctaccgttacgacggtaacggacgacgtacgtacggaataacgttaaacgacgtacgtcggactacggacctaaccgtacttacgttacgtaccttaccg

SEQ ID NO: 172371 - DNA, 633 bp, Homo sapiens
  misc_feature: GYAE6OF02GCEIT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtatagcttacactggtaccagcagaagccaggtcagtctccaaagctcctcatacaagtatcgccttcccacgtccttctccgtacggggtcccctcggaggttcgaggtcggacaggtggtatcgtgggactactacttttccacccctcacctactactaatacgaccgtaggaacgcgtagaagtagtgtcgtaggtacctaacgtttacttacttgtactatacgagtaacgttaacttacctttaacctacgtaacgtactacttaccctaccgtttaccggaaccgtaaacggaccaacggtacgtacgggaaacgtaaacgttaaaaccggtaacgttacggtacggtaccgtacgacctaaccttacgtaccgttacgttcctttaacccg

SEQ ID NO: 172372 - DNA, 572 bp, Homo sapiens
  misc_feature: GYAE6OF02JC16W.27.78.H01.1.454.CMB.1.raw
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggcagtcagagcgttggatagcttacactggtaccagcagaagccaggtcagtctacaaagctcctcatcaagtcngtctcccagtccttctcgacgggtccctgaggttcagtgcagtgatcgngggacactattccgaccctcacatcaatgcctaggaacgtctagaacgntcgctacgactaacgttattactgtacagtcaagtacgtacttaactttactactaagttcgacttaccgtaccgttccggaaccgaacgggtacgtaacgagtacgggaacgtaaacgttaaacgtacgttacggtacggtaccgtacgacctaccgtacgtttccgttacgtccttaaccg

SEQ ID NO: 172373 - DNA, 610 bp, Homo sapiens
  misc_feature: GYAE6OF02FZJ59.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccacctgccggcagtcagagcgttaggtagtagcttacacgtggtaccagccagaagccaggtcagtctaccaaagcctcctcatcaagtatggccttcccagttccttctcgtacggggtcccctggaggtttccaggttcggctaggtggactcgtaggggactacgtagtttaccacccgtctaccataccaactacgtccctaggacgtacgtaggaaagtcgtagcgtcgaacctaacgtttacttactagttctatcgaacgtacgttacttaaccttactacgtagtctacgtcctaccgttcggacgtaacgggacctacgacgtacggagtaaacgttaaacgaacgttaggtcggtacgtcgacctacgtacttccgtagtttacccg

SEQ ID NO: 172374 - DNA, 697 bp, Homo sapiens
  misc_feature: GYAE6OF02HVB2B.27.78.H01.1.454.CMB.1.raw
  modified_base (689)..(689): a, c, t, g, unknown or other
  misc_feature (689)..(689): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaaagtcaccatcacctgccgggccagtcagagtcgttggtagtagcttacacgttggtaccagcagaagccgaggtcagtctaccaagctcctcatcaagtctagtccttcccagtccttctccgacgggtcccctcggtacggttacaggtcggctaggtcggtacgtacgtcggggtaactacgtacttttcccgacccttaccaaccctagtacctaaacgtacggtaccgtaggtaaacgtaccgtaaggaaagacgttcggtacctacggtacttaaaccgttttaactttaccgtttaggtaccttaacgtacgtaacgttaacgtttaacctttaaccgttttaacccttacgtaaacgttacgttaaccgttaccctttaacccgggtaccggaaaccgggtaaccggaccgtacggtaacgtacggtaaacgttaacgtaaacgtacgtggtagcgtaccaccgtacctagtaccgttnttaacccg

SEQ ID NO: 172375 - DNA, 749 bp, Homo sapiens
  misc_feature: GYAE6OF02GV9T6.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggtagtagtacttacactggtaccagacagaacgccgaggtaccagtcctaccaaagcctcctcactacaaggttactcgtccttcccgtagttccccttcgtaccgaccggggttccccttacggtacgggtttacagggttcgggacgtaggtacggtaacttccggtacggggacctaaaccgttacttttacccacccccttacgaaccctaactacctaaagtaaccgtaccgtaggggtaacgtccgttagaaaggtactacggtacctacgtaaccttaaaccttttacgtttaaccgttgttaccgtaattaccgaaacggttaaacgtttacccgtttaaccctttttacccgttaaccgtaaacggttcgtaacctttaacccgttacccggttaaccccgggaaaccgtaaaccgggggtaacccgtaaccggttaaccggtacgggttaaacggttaagttaaaaacccgggg

SEQ ID NO: 172376 - DNA, 527 bp, Homo sapiens
  misc_feature: GYAE6OF02GPX99.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtccttctcagggtcccctgagttcagtggcagtggatctgggacacatttcaccctcaccatcaatagcctggaagctagaagatgctagactaacttattactgtcatcagtagtactactttactactaagtgactctaccttacggaccgaaggaccacgacgtaggaagtaactaaacggtaactggtacgcgtcgaccacccgtatcgttgtccttacg

SEQ ID NO: 172377 - DNA, 698 bp, Homo sapiens
  misc_feature: GYAE6OF02GJ91Z.27.78.H01.1.454.CMB.1.raw
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtacttttagtctgtgactccaaaggagaaagtcaccatcacctgccgggccagtcagagtcggttggtagtagtcttacacgtggtaccagcagaagccaggtcagtctaccaaagcctcctcatacaagtatcgcttcccgagttcctctcgacgggtccctgngttcagtgcagtgntcgtggacactnttccacctcacatacaactcgaccgtggaactcgtagaagtagtcgcgtacgtaaccttaaactttacgttaccgttcggtaactacgttacgtaacgttaacgttaaccttttaacctttaacccttaacgtaacggttactaaccgttacccgttaacccgtttaccgggaacccgtaaacgggtaaccgtaaccggtaaccggttaagggtaaaccggtttaaaccgttaaaaccgggtaaaccgtttacggggtaaccgggttaccgttaaccggtaccctaaccgtttaaccgtttccgttaccgggtttaccctttacgttaaccccccgg

SEQ ID NO: 172378 - DNA, 710 bp, Homo sapiens
  misc_feature: GYAE6OF02ILA21.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactcgaaagganaagtcacatcactgccggcagtcagagtcgttaggagtagcttacacgtggtaccagcagaagccaggtcagtctacaaacgctcctacatcgaagtatcgtccttccctagttccccttcgtccggaaccggggttccccctacggttacggttacgtacggtcggtacggaggtacgggtaacttcggtacgggtaacctacgttaacgttttacccacccgtacctaaaccgtactaacggtaaattacggtacccgtaagggtaacgacgttaacggaaacgttacgtacggtacgtacgtaaccgttaaacttttacttaccgttacggttaacaacgttaactaacggttaaacgttacctttaaacctttaacccgtacgtaaacgttcgtaacttacccgaccgttacccggaaacgtaaacggacgtaaccgtacgtaaggtacgtaaacttaaagacgttcggtagaccgtacgaccaccgtaacttcgttcgttacttaccg

SEQ ID NO: 172379 - DNA, 558 bp, Homo sapiens
  misc_feature: GYAE6OF02IJ8KE.27.78.H01.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (553)..(553): a, c, t, g, unknown or other
  misc_feature (553)..(553): n is a, c, g, or t
tcagagcgtcgtctcacgaccggtgctcgatttagtgtgagtagtttgggtttgggggatgagcaaaactgacaagtcaaggcaggaagatgttgccatcacaactcattggggtttctgctgctctgggttccagcctccaggggtgaaattgtgctgactcagtctccagactttcagtctgtgactccaaagganaaagtcaccatcacctgccgggccagtcagagcgttggagtagcttacactggtaccagcagaagcaggtcagtctccaaagctcctcatcaagtatgcttcccagtccttcncagggtcccctgaggttcagtcgcagtggatctgggacacatttcaccctcaccatcaatagctaggaagctagaagatagctagctaaacttattactagtacatacaaggtactaaccttactttaacctacaagttagattacgaccctttacgggacccaaagggacctaggacgtagggaacgtaacgttaaaacgaaacgtcggtacgggctcggaccaccctaagtccttcgttnttacc

SEQ ID NO: 172380 - DNA, 593 bp, Homo sapiens
  misc_feature: GYAE6OF02GDRXZ.27.78.H01.1.454.CMB.1.raw
  modified_base (197)..(197): a, c, t, g, unknown or other
  misc_feature (197)..(197): n is a, c, g, or t
  modified_base (580)..(580): a, c, t, g, unknown or other
  misc_feature (580)..(580): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtcctgtgactccaaagganaaagtcaaccatcacctgccgggccagtcagagcgttggtagtagcttacactggtaccagcagaagccagtcagtctccaaagcctcctcatacaacgtatcgaccttcccacggttccctttctaccgacggggttcccctcggacggttcaggtaggcaggtggatctgggactacgtacttaccaccctcaccatacaactacgccgtagggaaacgcttaggaaagacgtagacctagtacctaaactttagttacctgtaccatacgaagtacttacgttacttaccctaagtacgtacgtactcctacgttccgacggaaacggacgacgtacttacgaacgtaaacttaacgaacgtggtacgtctcgcaacctntcttgtccttacg

SEQ ID NO: 172381 - DNA, 600 bp, Homo sapiens
  misc_feature: GYAE6OF02FYZE0.27.78.H01.1.454.CMB.1.raw
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctggccggccagtcaggagcgttggtagtagcttacactggtaccngcagaagccaggtcagtctccaaagctctcatcaagtatncttccagtccttctcgacgggtcccctcgacggttcagtggcaggtggatcgtggactactatttccaccctccaacctataccaaagtacgcccgtaggaacgccgtagaagagtgactgacctaactttacttacgtgttactactactaacgtaacgtttaccttaacctttaccgtacgtaagttcgtaacttcccgtaaccctttccgggaacccgtaacgggtacctaaccggtacgtacgggtaacgtaacgttaaaaccgg

SEQ ID NO: 172382 - DNA, 577 bp, Homo sapiens
  misc_feature: GYAE6OF02GJTSR.27.78.H01.1.454.CMB.1.raw
  modified_base (234)..(234): a, c, t, g, unknown or other
  misc_feature (234)..(234): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
  modified_base (506)..(506): a, c, t, g, unknown or other
  misc_feature (506)..(506): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagtactttcagtctgtgactaccaaaaggganaaagtccaccattccacctggccgggccagtcagagcgttggtagtagcttacactggtaccagcaagacgccaggtcagtctaccaaaagcctcctcactacaagttatcgcgttacccacgttcccttctcgacgggttcccctcggacgtttcacgtggacaggtagactcgtggacactattccaccctcacatacatacgctagganctagaagntcgctgctaacttatactntcatctagacgttacttacttaccactaacgtntacgttacctaacccggttccggaccgtaacgggaccgtaaccgtacgacgggtaacgtagttaaaaccgg

SEQ ID NO: 172383 - DNA, 657 bp, Homo sapiens
  misc_feature: GYAE6OF02ID5YJ.27.78.H01.1.454.CMB.1.raw
  modified_base (428)..(428): a, c, t, g, unknown or other
  misc_feature (428)..(428): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggagtagcttacactggtaccagcagaagccaggtcagtctaccaaagcctcctacactacaaagttactcgaccttcccaggttccctttctaccgtacgggggtcccccttacggtaggttcaggtggacaggtcggatcgtgggactacgatttccaccctcaccactacaacgtacgcctagggaacncgtaaggaacgatcgacctagtacctaaacgtttactttaactcggttacgaacttcgaacgtaacgttaacctttaacgtttaaccctacgtaaacggttactaccttaccgttaacccgttacggaccgaaacgggacctaaccggtaccgtaagggtaagtaaacgtttaaaacgacgtttacgggtacggtcctaaggtccctaaccgtattccgtacgttcccg

SEQ ID NO: 172384 - DNA, 536 bp, Homo sapiens
  misc_feature: GYAE6OF02F611R.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatacaagtatgcttcccagtccttctcagggtcccctgaggttcagtgcagtgatctgggacacatttcaccctcaccatcaatagcctaggaacgctagaagatgctgactaacttattactgtacatacaagtacgtacttactttacctacaagtgactctaccgttcggaccgaacgggacaccggactaggaacgtaacttaaacgaactggtaggcgtacggaccaacctatccttgtcttacc

SEQ ID NO: 172385 - DNA, 568 bp, Homo sapiens
  misc_feature: GYAE6OF02GTJVK.27.78.H01.1.454.CMB.1.raw
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagacgcgttggtagtagcttacactggtaccagcagaagccaggtcagtctaccaaagctcctcatcaagtatgccttcccagttccttctcgacggggtcccctcggaggttcagtggcaggtggatcgtggactactactttcaccctcaccatcaatcgctaggaagctagaagntgctcgactaacttattactgtacatacagtacgttaccttactttacctataagtanactacctaccgttccggaccgtaaagggacctacggacgtaggaacgtaaacttaaacggaacgttggtacgtcgtacgaccaccgtacgtccgttcgttaccgttac

SEQ ID NO: 172386 - DNA, 626 bp, Homo sapiens
  misc_feature: GYAE6OF02GV4U2.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactcaaagganaaagtcaccatcacctgccgggccagtcagagcgttggtagtagcttacacttggtaccagcagaacgccaggtcagtctccaaagctcctcatcaagtatgccttcccncgtccttctcgtacgggtcccctcggtaggttcagtggcgtaggtgagtcgtgggaccacgtactttccgacctcacctataccaatacgtaccgtaggaacgtcgtagaaaggtcgtacgtcgtcgtaacctaaacgtttactttaccgttacgtactaacgttactaaggtaaccgtttactttaaccgtttaacctacgttaacgtagtaccttacctaaccgttcccggacgtaacgggaccgtacgtacgtaggtaacgtaacgttaaacgaaccgttgtacggtctacggactaccgattcctagttccttaccg

SEQ ID NO: 172387 - DNA, 519 bp, Homo sapiens
  misc_feature: GYAE6OF02GCAIS.27.78.H01.1.454.CMB.1.raw
  modified_base (386)..(386): a, c, t, g, unknown or other
  misc_feature (386)..(386): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaagctcctcatcaagtatgcttcccagtccttctcgacgggtcccctcgagttcagtggcagtgatctggacacatttcaccctcaacctatacaatacgcctaggaacnctagaagtactgactgactaacttacttactgtacatcagtatactactttacanagtnatcaccttcggaccaaggaccagacgtggagtaactaacgactggtcgactgaccaccgtatcttcgtcttacg

SEQ ID NO: 172388 - DNA, 836 bp, Homo sapiens
  misc_feature: GYAE6OF02IOZF4.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtnaaattgtgctgactcagtctcagtacttcagtctgtgactaccgaaaggagaaagtcacatcacctgccgggacagtcagagtcgttggtagtatcttacacgtcggttaccagaccgagaacggcctaggtcaggttaccctaccgaaaacggtcctccctacacgttaccgaaaggtttacctcggtaccctttaccccgtaaggttttccccttttaccggtcccggtaaccgggtttcccccgttaccgggtacgggtttacctacggggtaggttccgtaacggggtcgtaacgttacggtaccgggtaacgttaaccgttaatttacccgaaccccgttaccgtaaccccgttaaacgttaccgtaaacttaccgggtacccgttagggtaaaccggtccgtaaccggttaaagacgttaacggccgttagaacccggttaacctttaacgttacgtcgttaccgtaacgttacgtacgttaaccggttaacttaccttttaaccgtacgttacggtaacgttaccgttaccgttacccggttaccgggtaaccgtaaccgggaccgttaaccggtacgttaacggtaaacggttaaaccgttaaacggttaaccgttaccggttaacggttaccgtaccggttaaccgtaccctaggtttaccccttgggttttaaccccg

SEQ ID NO: 172389 - DNA, 691 bp, Homo sapiens
  misc_feature: GYAE6OF02ILY6Y.27.78.H01.1.454.CMB.1.raw
  modified_base (393)..(393): a, c, t, g, unknown or other
  misc_feature (393)..(393): n is a, c, g, or t
tcagagcgtcgtctcacgaccggtgctcgatttagtgtgagtagtttgggtttggggatgagcaaaactgacaagtcaaggcaggaagatgttgccatcacaactcattggtttctgctgctctggttccagcctccaggggtgaaattgtgctgactcagtctccagactttcagtctgtgactcaaaggagaagtcacatcacctgccggccagtcagagcgttggtagtagcttacacgtggtaccagcaaggaagccaggtcagtacctaccaaaagtcctccctctacgtacaaagttatcgtcctttccccaggttccctttcgtaccgaccggggttccccctaggtacggtttcaggttcggcaggtggatcgacgggacacgtntttaccacccgtacacctaactcctaaagtcgtaccgttagggaacgtacgtacggaaagtcgtagtcctagaccgttaaactttacgttaacgttacgtactacgttaccgaagttaacgttaacctttaacgttttaccctaacggttaagttaacgtaccttccgtaacccgttaccgggaacccgtaaacgggtacccgtaccggtaccggtaggtaaacggtaaacgtttaaaaccggaacgttcgtacggtaaccgtcgtacctaacccgagttaccttcgttaccttaccg

SEQ ID NO: 172390 - DNA, 708 bp, Homo sapiens
  misc_feature: GYAE6OF02GG09Q.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacacgtggtaccagcagaagccaggtcagtctaccaaacgctcctcataccaagttactacgtccttcccgagttaccctttcgtccgaccggggttccccctcggttacgggttcgacggtcggcgtaggtagggacttcgtcggggactaccgtactttacccgaccctccaaccctaatacctaaacgtacggtaccctagggaaacgtacgtacggaaagtacgttcgtacgtacgtaccgtaaacctttatttaaccttagtaccttaacgtacgtaacgttaacggtttaacctttactttaacccgtactaacgttacgtaacgttaccgttaaccgttacccggtaaccgaaacgggtaaccgaaccgtaccgtaacggtaacggttaaacgttaaaccggtacgttaaggttcggtactacggaccctaacctacttccgttacttctttacccg

SEQ ID NO: 172391 - DNA, 564 bp, Homo sapiens
  misc_feature: GYAE6OF02H946G.27.78.H01.1.454.CMB.1.raw
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagacttttcagtctgtgactcaaaggagaaagtcaccatcacctgccgggccagtcagagcgtttggtagtagcttacactggtaccagcagaagccaggtcagtctccaaagctcctcatcaaagtatgtcttcccagtccttcctcgacggggtcccctcgaggttcagtggcagtggatcngggacactnttcaccctcaccatcaatacgcctaggaacgctagaagagtgctgacaactttattacttgtcatcaagagttaccttactttacctactaagtgtacttcaccgtttacggccgaaacgggtaccaacggacgtacgggaagtaaagttaaaccgaacgttaggtcggtccgtacgccacgtacgttcttcgttcttacccg

SEQ ID NO: 172392 - DNA, 618 bp, Homo sapiens
  misc_feature: GYAE6OF02GJ5P8.27.78.H01.1.454.CMB.1.raw
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccgggccagtcagagtcgttggtagtagcttacactggtaccagcagaagccaggtcagtctaccaagcctcctcatacaagtatcgccttcccacgttcccttcctcgtaccggggttccccctcggtacggttcaggtcggcaggtggactcgtgggacacgtactttaccaccctcaaccataccaatacgaccgttaggaacgtacgtaggaacgagtcgtactcgtactaaacgtttattaccgtgtaactactacgaagtacgttaccttacctttacctaactaaggtcgtaaccttccgtaacccgttaccggaaccgtaacgggtaccaaccggtacgtacggtaacgtaacgttaaaccgg

SEQ ID NO: 172393 - DNA, 593 bp, Homo sapiens
  misc_feature: GYAE6OF02HM948.27.78.H01.1.454.CMB.1.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagagcgtcgtctcacgaccggtgctcgatttagtgtgagtagtttggggtttgggggggcatgagcaaaaactgacaagtcaaggcaggaagatgttgccatcacaactcattgggtttctgctgctctgggttccagccctccaggggtgaaattgtgctgactcagtctccagactttcagtctgtgactccaaaggagaaagtcaccatcacctgccgggccagtcagagcgttggtagtagcttacacgtcggtaccagcaagaagccaggtcagtctaccaaagctcctcatacaagtatgccttcccacgtccttctccgcggggtcccctcgaggttcgaggtggtagtggatcgtaggacactatttccaccctcacccatcaatacgactagggaatctagaagntcgntagactaacttattaacgtgtactagtacagtaacgttaccttaactttacctactagtacacttaccgtaccgtaccggacgaaacgggaccgacgtacgtaggtaacgtaagttaaaccgaacgttagtacggtacttacggacctaaccgacgttaccttgtacccttcg

SEQ ID NO: 172394 - DNA, 604 bp, Homo sapiens
  misc_feature: GYAE6OF02JIJM7.27.78.H01.1.454.CMB.1.raw
  modified_base (323)..(323): a, c, t, g, unknown or other
  misc_feature (323)..(323): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagactttcagtctgtagactaccgaaaggagaaagtcaccatccacctggccggccagtcagagcgttggagtagcttacactggtaccagcagaagccaggtcagtcaccaaagcctacctnaatacaagtatcgaccttcccagttcccttctcgacggggttcccctggacggtttcaggtcggactaggtggactcgtacggggacacgtactttccacccctcaacctatactaagtacgccgtaggaacgactagtaacgatcgactcgtaactaacttacttactcgtactatacaacgtacgttaacttacctttaccgtactacgttacgtaacttactaaccgttccggaaccgtaaggaaccgacgtaacgtaggtaagtaaccgttaaacgg

SEQ ID NO: 172395 - DNA, 726 bp, Homo sapiens
  misc_feature: GYAE6OF02GERPC.27.78.H01.1.454.CMB.1.raw
  modified_base (150)..(150): a, c, t, g, unknown or other
  misc_feature (150)..(150): n is a, c, g, or t
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctcgaggggtanaaattgtgctgactcagtcctccagtactttcagttctgtcgacctaccgaaaagggagaaacgtccaaccatccacctggcccgggacagtcagacgtcggttggtagtacgtcttacacgtcggtaccagcaagaacgccgaggtcagtcctaccaagcctcctacacttacgaagttatcgtccttcccgtacgttcccttacgtccggtaccggggtcccctaggtacggttcaaggtcggacgtaggtaggactacgtacgggtaacttaaacgttccctaccctactaaccctagtactaaacgtaccggtacccgtaagggaacctacgtaacggaaagtacttacggacttacggtaacctttaaacgttttacttaccgttacgttacctagttaaccgtaaggttaaccttaacccttttaaccgttaacccttacgtaacgttaccgtaacgttaccttacccggttaccggtaacccggaaacggtaaccggaaccggtacgtaacggtaacgttaacgtaaccggttaaccgg

SEQ ID NO: 172396 - DNA, 552 bp, Homo sapiens
  misc_feature: GYAE6OF02H3CYF.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctccaggggtcccctcgaggttcagtggcagtggatcgtgggacactatttcaccctcaccatcaatagcctggaagctagaagtatgctgacaactttattactgtcatcagagttactactttacctctaagtcgacttcctaccgttcggaccgaagggaccaccggactagggtaagtaaaccgtttaaacggaacttggtacggtctcggtaccaacctacttccgttgttaccc

SEQ ID NO: 172397 - DNA, 711 bp, Homo sapiens
  misc_feature: GYAE6OF02GE7JO.27.78.H01.1.454.CMB.1.raw
  modified_base (325)..(325): a, c, t, g, unknown or other
  misc_feature (325)..(325): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaacgtcaccatcacctgccgggccagtcagagcgttggtagtagcttacactggtaccagcagaagccaggtcagtctaccgaaagcctcctanactcaagtatcgtcctcccagttcccttcgtcgacggggttcccctacggtacgttcaggtgacgtaggttggattccgtagggacctacgtacgtttacccaacccctcccgaaccctagtacctaaacgtaccgacccgtagggaacgacgttagaaagtactggtacctagtaccgttaaaccgttttattacccgttacggttacctaacgttaccgtaacggtaaacgtttaaccgtttaacccgttttaaccctaccggttaaacggttccgttaaactttaccccgttaacccggtttacccgggaaacccgttaaacggggtaacctaaacccgggtaaccgtaacggggttaactaaacggttttaaaaaccccggg

SEQ ID NO: 172398 - DNA, 544 bp, Homo sapiens
  misc_feature: GYAE6OF02F9IBC.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagccttacactggtaccagcagaagccaggtcagtctcaaagctcctcatcaagtatgccttcccacgtccttctcgacggggtcccctcggtaggttcacgtggcgagtggactcgtgggacactattccaccctcacctactcaactacgcctaggacgtcgtagaagatgcgtgtactaacttattactgtcatacagtactacttacttactacagtacatcctacgttccggacgaagggacacgtacgtacggaagtaacttaacgactaggtcgacgtcacacctagtctgttacc

SEQ ID NO: 172399 - DNA, 811 bp, Homo sapiens
  misc_feature: GYAE6OF02GI5R7.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagttctgtgactaccgaaaggagaaagtcaccatccacctgccggccagtcagagcgttggtagtagcttacacgtcggtaccagacagaagccgaggtcacgtcctaccaaagcctacctacatacaagtatcgtccttcccgtacgttcccttcgtaccgtaccgggggttcccccttacggtacggttaccgtaagggtcgggaccgtagggttcgggtacgtttaccggtacggggtaacctaaccgttaccgttttaccccgacccccgttaccaaaccccgttaatacccgtaaaacgtacccggtaacccggttaacgggtaaacgtaccgttaacgggtaaaacggtacggttaccgtaccggttaacgtaaccccgttaaactttttaaccgttttaaccgttcggttaaccgttacgttaaccggtaacgtttaaaccgttaaccttttaacccgttttacccgttacgttaaacggtttacgtaaacccgtttacccggttaaccccgtttaccgggtaacccggtaaacgggtaccggtaaacccggtaccggtaacggttaaaccggtaaacgtttaaaaacccggg

SEQ ID NO: 172400 - DNA, 617 bp, Homo sapiens
  misc_feature: GYAE6OF02HVAFV.27.78.H01.1.454.CMB.1.raw
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (610)..(610): a, c, t, g, unknown or other
  misc_feature (610)..(610): n is a, c, g, or t
tcagagcgtcgtctcacgaccggtgctcgatttagtgtgagtagtttgggtttggggggcatgagcaaaaactgacaagtcaaggcaggaagatgttgccatcacaactcattggttttcgtgctgctctgggttccgtagcctccagggggtaggtaaattagttgctgactcagtctccagactttctagtctgtgactccaaaggagaaagtacacatcacctgccgggccagtcagagtcgttggtagtagcttacactggtaccagcaagaagccaggtcacgtcctaccaaacgccttcctaccatacgaaagttatcgcctttccctacgttccttcctcgaccggggtccctcgtaggttcaggtgcgagtcggctcgtggacacgtactttcccaaccctcaacctactacaactacgccgtcggaaagcgtaagaagatgactgtaacctaacttaactttacgttacgtcaatcgaagtacgttaccttaacctttacctnaagttnactaccttacggacgaccgaagaccgtacgaagtacgggaacttaaacgtaaacggtaagtcggtagactaccggacctaacgtacttcgtnttacccg

SEQ ID NO: 172401 - DNA, 691 bp, Homo sapiens
  misc_feature: GYAE6OF02G1X3F.27.78.H01.1.454.CMB.1.raw
  modified_base (197)..(197): a, c, t, g, unknown or other
  misc_feature (197)..(197): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcactgccggccagtcagagcgttaggtagtacgcttacgactcggtaccaggacagaacgccgaggtacagtcctaccgaaagctcctacatacaagtatcgtcctccagttccttcgtccgtacggggtcccctcggacggttcaggtcgacaggtgtactcgtaggactacgtacgtttccaccctcgtaaccactaccgaaacttacgtacccgtagggtaacgtaccgttagaagtacgtagaccttacgaccttaaactttacgttacgttacgtactaacgtacgtaaacggttaacgttaacctttaacccgttttaaacctcgtaaacgttacgtaatttaccccgtaaccggtttacccggaaccgtaaaggggacccctacgggtaacttaaggggaactttaaaccgttaaaaccggtaacttcggtacggtacttcggaaccgtaccctaacgttcgttagtttaccccg

SEQ ID NO: 172402 - DNA, 646 bp, Homo sapiens
  misc_feature: GYAE6OF02IW86X.27.78.H01.1.454.CMB.1.raw
  modified_base (146)..(146): a, c, t, g, unknown or other
  misc_feature (146)..(146): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccgaaaggagtaaagtcaccgatccaccgtcggccgggaccaggtccagacggtcgttaggtacgtagtccttacgacgtcggtaccagcagacgccaggtcagtctaccaagctctcatcaagtntcgcctccagtcctcncgacgggtccctgtgttcaggtcgctaggtcgatcgaggacctacgtacttccacccgtcaccgtactacgaacttacgccgtaggaacgtccgtaagaacgtatacggtctacgtacttaacttacttacgtctatacgtacgtaagtaacttaccgtttaacctttaaccgtacgtaacgtacttacgttaccgtaaccgtttccggaacggtaacggtaccgtacgtacgtacggtaaacgtaaccggttaaaccgtacgttacggtaccgtcgtaccggtacctaccgttactccgtttacgtaccttacccg

SEQ ID NO: 172403 - DNA, 622 bp, Homo sapiens
  misc_feature: GYAE6OF02HXQV9.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaagtcacatcactgccggcagtcagagcgttggtagtagtcttacacgtggtaaccagccagaagccaggtcagtctaccaaagcctcctcatacaagtatgcttcccagtcccttctcgacggggtcccctggtacgttcgagtggctaggtggtatcgtgggactactcgtttccacccgtaccacctactacaaatacgtccgtagggaacgccgttaggaagtagtcgcgtacgtactaaactttattaaccttgtcctattcgaacgtaggttaacctttacctttacctactaaggttctaacttcctaccgtttaccggaccgaaacgggaccaacgtacgtacggaacgtaacgttaaacggtacgtacggtggtaccgtacgaccgtaaccctacgtaccttacggttacttacccg

SEQ ID NO: 172404 - DNA, 698 bp, Homo sapiens
  misc_feature: GYAE6OF02IEC95.27.78.H01.1.454.CMB.1.raw
  modified_base (185)..(185): a, c, t, g, unknown or other
  misc_feature (185)..(185): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtagaaattgtgctgactcagtctccagtactttcagtctgngacctaccaaaggagaaagtcaaccatccacctcggccgggccagtacagaggtcgttaggtagtagtacttacacgttggaaccagacaagaacgcaggtcagtcctacaaacgtctcctacatacaagtactcgtccttaaccctgtcccttctaccgaccggggttcccctacggtggttaccacggtggaccgtaaggtgggtaactcgttacggggacctaacgtacttttcccaacccttacaaccctagtaaccgaaagtttacggcccgttaagggaacgtccttaaggaagtaacgtcggtactaacggaccttaaacttagttaccgtattaccgtataccgaggttaacttaacctttaacgtttaaccctaaccgtaagtactaaccgttaccctaccggtttaaccggacggtaaaacgggaactacggtacgtacggtacgtaaacgttaaaccgacgttagacgtcgactaccgtaccagttaccttcttacgtaccc

SEQ ID NO: 172405 - DNA, 570 bp, Homo sapiens
  misc_feature: GYAE6OF02GOQ55.27.78.H01.1.454.CMB.1.raw
  modified_base (413)..(413): a, c, t, g, unknown or other
  misc_feature (413)..(413): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgccttcccagtccttctccagggtcccctgaggttccagtcgcagtggatcgtggactacatttcaccctcaccatcaactgcctaggaagctaggaagacgtagctagactaacgttnttactgtcatcaagattaccttactttacctacgagttagactaccgtaccttaccggaccgtaaacgggtaccgaaccgtactacgggaagtaaacgtttaaaccggaactaggttacggacgtcggactacccgtaatccgtttagtccttaccg

SEQ ID NO: 172406 - DNA, 614 bp, Homo sapiens
  misc_feature: GYAE6OF02JHJS7.27.78.H01.1.454.CMB.1.raw
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggggcgatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggagtagcttacacgttggtaccagcagaagccaggcagtctccaaagcctcctcatcaagtctgtcctaccngtcccttcacgtcgggtacccctcgtaggttcaggtgccgagtcggtatcgtcgggaacnctatttaccaccctctaacccgtntacgaacgtcgaccgttacggaaacgtccgtaaggacgtaacgtcggtcctaggacctaacgtttacttaagtcgtaacgataccgaaggtacttactttaaccttactacgtaagtgtactaccgtacgttaccgacgtaacggaccgtacgacgtacgggtactaactaaacgtaacgtacgtggtactacggtaccaacctcggttactcgttaccg

SEQ ID NO: 172407 - DNA, 787 bp, Homo sapiens
  misc_feature: GYAE6OF02J2F88.27.78.H01.1.454.CMB.1.raw
  modified_base (205)..(205): a, c, t, g, unknown or other
  misc_feature (205)..(205): n is a, c, g, or t
tcagagcgtcgtctcacgaccggtgctcgatttagtgtgagtagtttgggtttggggggcatgagcaaaactgacaagtcaaggcaggaaggatgttgccatcacaactcattgggtttctgctgctcctgggttcccaggcctccaggggtgaaattcgtgctgactcagtctccagtactttcagtctgtgactccaaagganaaagtcaccatcacctgccgggccaagtcagagcgttgggtatgcttacacttcggtacccagtccagaaacgccgaggtacaggtcctaccgaaacgtcctaccctcaataccaaagtatcgtccttacccacggttcccttcgtcgtaccgggggttcccccctggtaacggggtttccaagggttcgggacccgtagggtttacggggacgttaccggtacggggtaaccctaccttaaccgtttacccaaccccgttcccaaaacccgttactaaccgtaaacgttaaccggacccgttaaggggtaaacgtaccgtaacggtaaaccggtaagttccggaccgttacgtaacccttaaaccgttacttttaaccgtcgggttaacctaccgttacggaaactttaccgggttaactttaaacccttttaaccccggattaaacgggtcgttacctaacccgttacccgtttaccgggaaccgtaacggggaacctaccgggtacgtagggtaacttaaaccggaacgttaacggtcgtacggtcctacggaccttacccggtattccgtacgttacc

SEQ ID NO: 172408 - DNA, 625 bp, Homo sapiens
  misc_feature: GYAE6OF02FHQLB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgtccttcccagtcctttctccgacggggtcccctggacggttcagtggcaggtggatcgtgggactactactttccaccctacgaacctatcaactacgaccctaggaacgctaggaagtacttgctagtacctaactttatttaccttgtactatacgaagtaacgtttaaccttaaccgttttaccacgttaacgttacgtaacttacccttaacccgttcggaaacccggtaacgggaccctaacggtacgtagggaacgtaaacgttaaaccgaacgttacggttacggcttacgcctaaccgtagtccgttagttaccttaccg

SEQ ID NO: 172409 - DNA, 526 bp, Homo sapiens
  misc_feature: GYAE6OF02GDHB5.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctccaaagctcctcatcaagtatgcttcccagtccttactcgtacggggtcccctcgacggttcacggtggcagtggatcgtgggacactattccaccctcaccatcaatacgcctggaagctagaagtatgctagctaacttattactgtcatcagtatacttacttacctcaagtcatcaccgtcggaccaaggcacgactggaactaactaaacgactagtggtactcgacctaccattctgttcc

SEQ ID NO: 172410 - DNA, 543 bp, Homo sapiens
  misc_feature: GYAE6OF02FRZJX.27.78.H01.1.454.CMB.1.raw
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagagccaggtcagtctccaaagctcctcatcaagtatgcttccagtccttctcacgggtccctcgaggttcagtgcagtggntcgnggacactacttcaccctcaccatcaactacgcctaggaacgctagaagattgctagacctaacttacttactgtacacttacagtacgttacttacctttacctactaagtcacttaccaccgttcgaccgaacgggaccacgtacgtgaacgtaacttaacgaacgtgtcgctcgaccaccgtactctcgtcttaccg

SEQ ID NO: 172411 - DNA, 670 bp, Homo sapiens
  misc_feature: GYAE6OF02FGDHF.27.78.H01.1.454.CMB.1.raw
  modified_base (194)..(194): a, c, t, g, unknown or other
  misc_feature (194)..(194): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggngaaagtcaccatcacctgcccgggcagtcagagcgttggagtagcttacactggtaccagcagaagccaggcagtctacaaagctcctcatcaagtatgcttccagtccttcgcgacgggttcccctcgtacggttcaggtcggactaggtggactcgtagggacacgtacgtttccaccctcaaccgactacaaatcgacctagggaaacgcgttagaagtagttcgcgttacgtacctaaactttagtttaaccgtcgtaccgtaattacgaacgttaacggttacctttaaccgtttaaccctaacgtaaacgttcgtaaccttaccgttaacccggttaccggaacccgtaaacgggacccgtaaccggaacgttacgggaaacgttaaacgtttaaaaccggaaaccgtttcgggtacggtacccgtacggtaccctaaccctaacgttccttacggttacctttaacccg

SEQ ID NO: 172412 - DNA, 646 bp, Homo sapiens
  misc_feature: GYAE6OF02HX218.27.78.H01.1.454.CMB.1.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (335)..(335): a, c, t, g, unknown or other
  misc_feature (335)..(335): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtnaattgtgctgactcagtcctccagtacctttcagttctgtcgactaccgaaaagganaaacgtcaccatccacctcggccggcagttcaggagtcgttaggagtacgctttacacgtggtaccagcagaacgccaggtcagtcctacaagcctccncatcaagtatcgtccttcccagttcccttcgccgtacgggttcccctaggtacggttaccgaggtcggtcgtacggtacggtactcgtacgggtaactaccgttactttcccaccctaccacctataccaacgtacgtcgtaacggagtacgtagaacgtactcgtaccgtagtaccttaacgtttacgtacttacgtactacttacgtagtaacgttacttaccgtttacgtaactaggtataaccttaccgtaaccgttccggtaacgaacgggtccaaccggtcgtaacggtacgtaaacttaaacgg

SEQ ID NO: 172413 - DNA, 682 bp, Homo sapiens
  misc_feature: GYAE6OF02GVZPA.27.78.H01.1.454.CMB.1.raw
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccaacctccaggggtgaaattgtgctgactcagtctccagactttcagtctgtgactaccaaaggagaaagtcaccatcacctgccgggccagtcagagcgttggtagtagcttacactggtaccagcagaagccaggtcagtctaccaaagcctcctcactcaagtatgcttcccagtcctctcgacgggtcccctcgngttcgagtgcngtgntcgnggacactacttcaccctcacctactacaatacgtccgtaggaaagtccgtaaggaaagtacgtacggtaccgtacgtaccgttaaacctttacgtttaacgtcggtttaaccagttaccgtaacgtaacgtttaaccctttaaccctttacccgttaacgttaacgtttacgtaaccgtttccttaaccccgggtttcccgggaaaccgtaaaccggggtaacctaacccggtaaccggttaggaaaccggttaaaggttaaaacccggtaagttacgggttcgaccgtttacggacctactacgttaccgttacgtttacttaccgttaccc

SEQ ID NO: 172414 - DNA, 727 bp, Homo sapiens
  misc_feature: GYAE6OF02IONGD.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaagtcaccatcacctgccggcagtcagagcgttggtagtagcttacacgtggtaccagcagagaccaggtcagtctaccaaagctacctcatacaagtatgcttcccagtccttctcgacggggtccctcggtacggttcgtacggtcggtccaggtcggactcgtacggggacctaacgtacgtttaccaaccctaccgtaacctacgtacgtaaactacggtacccgttagggtaaacgtacgtttagggaaacgtacgtttaacggcccgttaacggtaaccttaaacgtttttaaacgtttacgtttacggttactaaacttacgtaacgtaaacgtttaaccctttaaacctttaccctaacgttaacgttacgttaacttacccgtacccgtttacggaaacccgtaacgggtaacgtaccggtaacggtacgggtaaacggttaaaccttaaacggtaaccgttaggtcggtaccgttaccggaccctaaccgttaccgtttacgttactttaaccccgg

SEQ ID NO: 172415 - DNA, 735 bp, Homo sapiens
  misc_feature: GYAE6OF02JR8MD.27.78.H01.1.454.CMB.1.raw
  modified_base (146)..(146): a, c, t, g, unknown or other
  misc_feature (146)..(146): n is a, c, g, or t
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgngctgactcagtctccagtactttcagtctgtgactccaaaggnaagtcacatcactgccggcagtcagngcgttggtagtancttacactggtaccagcagtaacgccaggtcaggtctacgaaagtctcctacatacaaggtactcgccttaccgagttcccttcgtcgaccggggttcccctaggtacggttcgaggtcggactaggtggtaacttcgtacggggacctacttacgtttaccgaacccttcgtaaccctacgttaccctaaacgttaccggtcccgttaacgggtaaccgtacgttaaggaaacgtacgtacgtacgttaccgtaccgttaaacgtttacttaccgttacgttactacgttacgtaacggtaccgtttaccttaccgttttaaccgacgttaacgtcggttaacctaccgttacccgttacggtaacccggtaacggtaaccgtaaccggttacgtaagggttaaaccgtaacgtttaaaccggtacggttacggttaacggtacctacggttacccgttaaccgtaacgttttccgttaacggttcccgtttaacccgg

SEQ ID NO: 172416 - DNA, 654 bp, Homo sapiens
  misc_feature: GYAE6OF02JFPGA.27.78.H01.1.454.CMB.1.raw
  modified_base (146)..(146): a, c, t, g, unknown or other
  misc_feature (146)..(146): n is a, c, g, or t
  modified_base (293)..(293): a, c, t, g, unknown or other
  misc_feature (293)..(293): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactaccaaaggagaaagtcaccatcacctgccggcagtcagagtcggttggtagtagccttacacgttggtaccagcaagaacgccaggtcagtctacaaacgctcctnactcaagtacgtcgtaccttcccacgttccttcgtaccgccggggttcccctcggtaggttcgaggtggtcaggtcggattcgtcgggtaactacgttactttaccaccctacacctatacaacgtacgtccgtacggaacgtacgtagaaacgtgtcgctacgtactaactttacttactcgtaacacgtagtacgtaacttactttaacctttacctacgtaacgtcgtaacttccgtaaccgttacggacccgtaaacgggacaccggtacgtacggtaacgtaaacgtttaaaccgaagttccgggtaacgtacgttaccgacgttaacctcgtttacgttaccgttacctttaccg

SEQ ID NO: 172417 - DNA, 565 bp, Homo sapiens
  misc_feature: GYAE6OF02FWB5N.27.78.H01.1.454.CMB.1.raw
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagcctcctcatcaagtatgcttcccagtccttctcacgggtcccctcggaggttcagtggcagtggatcgngggacacatttcaccctcaccatcaatacgcctggaanctagaagatgctgactaacttattactgtacatcagtagtaccttaactttaccataacgtagactcctaccgtttccggacccgtaacgggaccaaccggtacgtaggaacgtaacgttaaaaccgaacgttagtacggacttacggacctaaccctattccgttacgttctttaccg

SEQ ID NO: 172418 - DNA, 718 bp, Homo sapiens
  misc_feature: GYAE6OF02H9PZV.27.78.H01.1.454.CMB.1.raw
  modified_base (333)..(333): a, c, t, g, unknown or other
  misc_feature (333)..(333): n is a, c, g, or t
tcagagcgtcgtctcacgaccggtgctcgatttagtgtgagtagtttgggtttggggagtcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagacttttcagtctgtgactaccgaaaggagaaagtcaccatcacctgccgggcagtcagagcggttgagtagcttacacgtggtaccagacagaacgccgacggtcacgtcctaccaaacgctaccctnactacaagtactcgtccttccaacgttcccttacgtaccgtaccggggttaccccctacgggttaacgttccgtaaggtcggtaccgtagggttacggacgtttccgggacgggtacctaacgttacgttttaccccaaccccgtaccaaccctataacaaacgtttacggaccgtacggaaacgtcctaaggtaagtagtcgaccgttacgaaccttaactttaactttaccgtagttaccgtaacgtaccgaaagtaaccgtttaactttaacccgttaccttacgtaaggttacctaactttcccgtaaacccggtttccggaacccggtaaacggtacccgtaacgttaacggtaacgtaacggttaaacgttaaaaccgg

SEQ ID NO: 172419 - DNA, 508 bp, Homo sapiens
  misc_feature: GYAE6OF02FQWTC.27.78.H01.1.454.CMB.1.raw
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtgcagtgatctggacacatttcaccctcaccatcaatcgcctggaacnctagaagatgctgacaacttattactgtcatcagacttactactttaccntagtnatcctacttcggacaagggacacgactaggagtaacttaaacgactggcgtacgtcgcaccatctagtcttac

SEQ ID NO: 172420 - DNA, 763 bp, Homo sapiens
  misc_feature: GYAE6OF02FF0WZ.27.78.H01.1.454.CMB.1.raw
  modified_base (321)..(321): a, c, t, g, unknown or other
  misc_feature (321)..(321): n is a, c, g, or t
  modified_base (716)..(716): a, c, t, g, unknown or other
  misc_feature (716)..(716): n is a, c, g, or t
  modified_base (745)..(745): a, c, t, g, unknown or other
  misc_feature (745)..(745): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctcgtggttccagcctcgagggtaaattgtgctgactcagtctcctagtactttcagtctgtacgactaccgaaaggacaaacgtccacctagtccaccgtcggccgggccagtccaggagtcgttaggtacgtacgtccttacacgtggtaccagacagaacgccgaggttacacgtcctaccgaaacgcctaccctntaacgtacaagtctacgtcccttaccgaccgtttccgttaccgtccggtaccggggttacccctacggtacggtttaccgtaagggttccggaccgttaaggttccgggtaacgttcccgggtaacgggtaaccccttaacctttacccgtttaccccaaccccgttaaccgtaaccctaacgtaaccgttaaacgaccggtaaccggttaacggaaacgttacgaaacgtaacgtaacgtccgtacttaacggtaaccttaaacgttacgttacacgttactaacgtaacgtaacgtaccgtttaaccttaaccgttaccgtaacgtaacgttcgaaccgtttacccgaaccgttaccggaacgaacgacctacgtagtacgtaaacggttaanaacccggtagtagtccgtacacggtaccncgtacttcgtacgttacc

SEQ ID NO: 172421 - DNA, 673 bp, Homo sapiens
  misc_feature: GYAE6OF02I3I0E.27.78.H01.1.454.CMB.1.raw
  modified_base (178)..(178): a, c, t, g, unknown or other
  misc_feature (178)..(178): n is a, c, g, or t
  modified_base (233)..(233): a, c, t, g, unknown or other
  misc_feature (233)..(233): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctccaggggtnaaattgtgctgactcagtctccagtactttcagtctgtgacctaccgaaaggganaaacgtccaaccactaccaccgtcggcccgggccagtcaggtaggtcgttaggtagtacgtaccttaacgacgttacggtaccagcgaagaacgccgaggtccagtacctaccgaacgtcctcctacactaccgaagtactcgtaccttaccctagttccctccgtacgtaccggggtccctacggtacggttacgacgtcggacctaggtcgtatcgtacggaacctacttacttcccaccctcacctactacagtacgtacgtaggaatacgtagaacgtcgtacacttacgtacttaactttacttacgtacgtactacgttaacgaacgttaacgttaacctttaccttaacgttagtacgttaacgtaccttaaccgtaccgttacccggaacgaacggtacgtacggtaacgtaggtaacgtacgttaaaccgg

SEQ ID NO: 172422 - DNA, 785 bp, Homo sapiens
  misc_feature: GYAE6OF02IPW8V.27.78.H01.1.454.CMB.1.raw
  modified_base (180)..(180): a, c, t, g, unknown or other
  misc_feature (180)..(180): n is a, c, g, or t
  modified_base (234)..(234): a, c, t, g, unknown or other
  misc_feature (234)..(234): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtnaaattgtgctgactcagtctccagtactttcagtctgtgacctaccgaaagganaaacgtcaccatccaccgtgccgggaccagtcagagtcgttggtaagtacgcttaacactggtaccagacagaacgccgaggtacgagtcctaccaaacgtcctcctctaactacaagtatcgtaccttacctacgtcccttcgtaccgtaccggggttccccttacggtacggttacgtaacggtcggtacgtagttcgggtacgtacggttacggggtaacctacgttaaccttttaccccgaaccccttacccgaaacccttaacgtaaccctaaagttaacccggtacccgttaaagggtaaccggtaccgttaacggaaaccgtacgttaccggtaccgttacggtaacctttaacgtttaacctttaaccggttacgttaactaccgttaaccgaaagtttaaaccgttacctttaaccgttttacctaacgttaaggttaaccgtaaccggtttaacccgtaaccggttacccggtaaacccgggtaaacggtacgtaacccggtaacgggtaacgggttaacggtaaaccgttaaaacccggg

SEQ ID NO: 172423 - DNA, 749 bp, Homo sapiens
  misc_feature: GYAE6OF02HX2VE.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtacctttcagtctgtcgactaccaaaaggagaaagtccaacactcacctgccgaccagtcaggagcgttaggtagtacgtcttacacgtggtaacccaggcaagaacggcctaaggtccagtcctaccgaaacgtcctaccctcgaattaccaaggttactcggtacctttccccagtttccctttaccgtaccggtaccggggttccccctacgggtacggtttcgaacgggtcggtactagggtacggtacgtaggtcgggtaaacctaccgttacgtttacccgaaccccttacaacccgtaacgttaccaaagttaccggtacctagggtaaacctcgtaagaaggtactcggtacgttacgtaaccgttaactttaccgtttacgtacgtaccgatttacccgagtaacccgtttaactttaccgttaacctacgtaaagtcgtaaccgttaccgttacccgttaacgggtacccgaacgggtccgtaacggtcgtacgggtaactaacgttaaacggtcgttacggaccggttcgtaccggacctaccgtcgtttaccgtcgtttacccg

SEQ ID NO: 172424 - DNA, 635 bp, Homo sapiens
  misc_feature: GYAE6OF02F9LI8.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtnaaattgtgctgactcagtcctccagactttcagtctgtgactccaaaggagaaagtcaccatcacctgccgggcagtcagagtcgttggtagtagcttaacgactggtaccagcgaagaagccaggtcagtctaccaaagcctcctcactacaagtatcgtaccttcccctagttcccttacgtcgtaccggggttcccctcggtaggttccaggtcggacgtagtggacgtcgtggactacgtactttccacctcacactacaagtacgaccgtaggaactcgtagaacgtatcggtctacgtacctaaactttacttacgttcgtactactacgagtacgtaacctttactttaccagtacgtataccttaccaccgttaccggaacgtaacggggtaaccctacggtacgtacggaacgtaaacgttaaacggacgttaacggtcgtactacggtacctaaccctagttccttacgttccttaaccg

SEQ ID NO: 172425 - DNA, 645 bp, Homo sapiens
  misc_feature: GYAE6OF02JUPN0.27.78.H01.1.454.CMB.1.raw
  modified_base (227)..(227): a, c, t, g, unknown or other
  misc_feature (227)..(227): n is a, c, g, or t
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactcaaaggnaaagtcaccatcacctgccggccagtcagagcgttaggtagtagcgttacacgtcggtaccaaggcaggaaagcccgaggtccagtctacccgaaaagccttccctacatacaagttactcgcctttccccaaggttcccttcgtcgaccgggggtcccccttggacggtttctaaggtgtccagggtcggactcgtagggactacgtactttcgtaaccccncaccatcaaatcgactaggaactcgagtaaagntcgtactcgaacctaacgtttattaaccgtgtcctaagttaccgtaagtaacgttaccttaacctttaccgtacgaacgttacgtaaccttccgtaacccgtttccggaaccgtaacgggtacctaacccggtacttacggggtaacctaagttaaaaccgg

SEQ ID NO: 172426 - DNA, 630 bp, Homo sapiens
  misc_feature: GYAE6OF02I6JBI.27.78.H01.1.454.CMB.1.raw
  modified_base (291)..(291): a, c, t, g, unknown or other
  misc_feature (291)..(291): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccggccagtcagagtcggttgggtagtagcttacacgtggtaccagcagaagccgaggtcagtctccaaagcctccncatcaagtatgcttcccagtccttctcgacgggtcccctgtacggttcagtggcaggtggatcgtgggactactactttccaccctacaccctatacctaagtcgtaccgtaggaacgtccgtaggaacgagttgaccgtacgacttaaaccgtttactttaccgttacgttacgtacttactaagttacgttacctttaacctttacctactaacgttacgtactaacctcccgtttacggaacccgtaagggacctaaccggtacgtacggaagtaaccttaaacggacttcggacggtaccgtacggacctacccgtatccgttcgttccttaccg

SEQ ID NO: 172427 - DNA, 676 bp, Homo sapiens
  misc_feature: GYAE6OF02G4NYN.27.78.H01.1.454.CMB.1.raw
  modified_base (147)..(147): a, c, t, g, unknown or other
  misc_feature (147)..(147): n is a, c, g, or t
  modified_base (425)..(425): a, c, t, g, unknown or other
  misc_feature (425)..(425): n is a, c, g, or t
  modified_base (636)..(636): a, c, t, g, unknown or other
  misc_feature (636)..(636): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgtgctgactcagtctccagtactttcagtctgtgactacaaaggagaagtcaccatccaccgtcgcccgggaccagtaccagagtcggttggtagtacgctttacacgttcggaaccagcagaagccagggtcagtcctaccaaacgtcctcctacatacaagttatacgtccttccctacgtttcccttctcgtaccggggttcccctcggtaggttccgtaggtcggcgtaggtcggtatcgtcggacctatactttccaccctacacctanactaactacgcgtaggaagtcgtaaggtaagagtcgtactacggtacttaaaccgtttacttacgttgtacctaagtaccgtagtaaccgtttaccttaaccgtttacctacggtagtacctaaccgttcccttaaccgttacccggacgaaacgggaccgtaaccgtagtaacggtaacgtaacgttaaaccggacggttggtaccggtntaccgtacctaccgttacgtactttccgttacttacccgg

SEQ ID NO: 172428 - DNA, 588 bp, Homo sapiens
  misc_feature: GYAE6OF02FS3VY.27.78.H01.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactccaaaggagtaaagtcacatacacctgccgggccagtcagagcgttggtagtagcttacactggtaccagcacgaagccagtcagtctccaagctcncatcaagtancgctccagtccttctcgcgggtcccctcggacggttcagtcggcaggtggatcgtgggacacgtacttccaccctcaccatacaactcgcctggaagctagaagagtcgcgtagactaacttattacttgtactattacgaagtacgttaaccttactttaccttacgtaagtcgtaattccgttaacccgttcggaacccgaacggggaccaacgtacgtaggtaacgtaacttaaaaccggcttaagggtacgtacgtcgaccaaccctagtaccgttcgtctttaacccg

SEQ ID NO: 172429 - DNA, 650 bp, Homo sapiens
  misc_feature: GYAE6OF02GDKO5.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtccttctcagggtcccctgaggttcagtgcagtgatcgtggacacgtatttccaaccctcgaccagtacaatacgccgtaggaacgccgaaagatggactgacctaaacgttacttacgtcgttacgtactcgtaagtaacggttaaccttaaccgttttaacctacgtaaacgttcggtaaccttcccgtaacccgtttccgggaacccgttaaacgggaaccgaaccggtaaccgtacgggtaacgttaaacgtttaaaaacccggaacgttacgggtccgggtaccttacgggaacccttaacccgtagttacccgtttacggtttccctttaaccgtaacccg

SEQ ID NO: 172430 - DNA, 648 bp, Homo sapiens
  misc_feature: GYAE6OF02GQG2P.27.78.H01.1.454.CMB.1.raw
  modified_base (149)..(149): a, c, t, g, unknown or other
  misc_feature (149)..(149): n is a, c, g, or t
  modified_base (257)..(257): a, c, t, g, unknown or other
  misc_feature (257)..(257): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtnaaattgtgcttgactcagttctccagtacctttcagtctgtgactccgaaaggagaaagtcaccatcactgccgggccagtcagacggtcgttggtagtagtcttacncgtaggtaccagcaagaacgcctaggtcagtctacaagtcctcctcatcaagtacgtcgccttccgagttccttcgtccgtacggggtcccctaggtacgttccaggtggacgtagtggacttcgaggtactacgtactttccaccccttagaacccgtataccgtaagtacgaccgtaaggtaacgccgtaaggaaacgtagtcggtactaacggtacctaaacgtttacttactacgttacattacgtacgtaacgttaccttaactttaccgacgtaagttcgtaccgtttacgaccgttccggaaccgaacgggtaccacgtacgtagggtaactaaagttaaccggacgttggtacgacgtcgtacctacgtactaccgtgttacc

SEQ ID NO: 172431 - DNA, 670 bp, Homo sapiens
  misc_feature: GYAE6OF02H1HRB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaagtcaccatccaccgtggccgggcagtcagagtcggttggagtagcttacacgtggtacagcagaacgccaggtcagtccacaaagcctcctcatacaagtactcgtccttccctagttcccttcgtaccgtaccgggttcccctggtacggttcaggtcggcgagtggtctcggtaggtactacgtacttccaccccgtcaacctactactaacgtacgtccgtagggaactcgtaagaagtactagcgtagacttaactttaacttacttacggtactacgttaccgtaagttaacgtaaccctttacttaaccgtacgtaagtacttaccgtaccgttaacccgttcggaaacccggtaggaaacccgtaccggtacgttaacgggtaacgtaaaacgttaaccggtaacggttggtaccgtacgtacgtaccctaaccgttacgttccgttacgttcccttaaccg

SEQ ID NO: 172432 - DNA, 706 bp, Homo sapiens
  misc_feature: GYAE6OF02HLYL5.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaattgtgctgactcagtctccagtactttcagtctgtgactaccgaaaggagaaagtcaccatcacctcgccggccagtcagagcgttaggtagtagcttacgacgtcggtaccagacaagaacgccaggtcacgtcaccaaagctcctacatacaagttactcgtccttacccgacgtttcccttccgtaccgtaccggggttcccccttacggtacggttccgaggtcggcgtacggtggacttcggtacgggtactaacgtactttcccgacccctacgtaaccctaattaccaaagttccgtcgtacgggaacgtacgtaaggaagtacgtacgtcgtactacgttaaaccgtttattaccgttacgttaccgtaacgttacgtaacgttactttaacccttaaccgtttaacctaacggtaagtaccggtaacttaccgtacccgttacggaacccgtaagggaccaacgggtacgttaaggaaacgtaacgttaaaccggcgttacggacgtaccgtacgtaaccaccgttatttaccgtgtttaccttacccg

SEQ ID NO: 172433 - DNA, 636 bp, Homo sapiens
  misc_feature: GYAE6OF02IMQ4X.27.78.H01.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
tcagagcgtcgtctcacgaccggtgctcgatttagtgtgagtagtttgggtttgggggatgagcaaaaactgacaagtcaaggcaggaagatgttgccatcacaactcattgggtttctgctgctctgggttccagcctccaggggtgaaattgtgctgactcagtctccagtactttcagtctgtgactccaaagganaaagtcaccatcacctgccggccagtcagagtcggttggtagtagcttanacgtggtaccagcagaacgccaggtcagtcctaccaaagctcctacatcaagtatcgtccttacccagttccttctcgacgggtcccctgtacggttcagtcgcagtggatcgaggaccacgtctttaccaccctacaactactacgaatacggaccttagggacgtacgtacgaaagtagtcgtactcggaacttaacgtttaatttaccgtcgttaacgacttacgtaaggttaacttaacctttacctttaacccgtagtaaacgttgaccttaccgtacccgttacgggaaccaaagggtacccaggtacgtaaggacgtaaacgttaaacggacttgggtcgtaacgcgtaccgtacctacggtacttcggttaccttaccg

SEQ ID NO: 172434 - DNA, 567 bp, Homo sapiens
  misc_feature: GYAE6OF02IUSLY.27.78.H01.1.454.CMB.1.raw
  modified_base (194)..(194): a, c, t, g, unknown or other
  misc_feature (194)..(194): n is a, c, g, or t
  modified_base (540)..(540): a, c, t, g, unknown or other
  misc_feature (540)..(540): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttcagcctccagggtgaaattgtgctgactcagtctccagactttcagtctgtgactccaaaggnaaagtcaccatcactgccggcagtcagagcgttggtagtagcttacactggtaccagcaagagccaggtcagtctaccaaagctcctcatcaagtatgcttacccagtccttcgtcgtacgggtcccctaggacggttcgagtcggctagtggtatcgtagggacacgtagtttccaccttcgacaataccaagtacgccgtaggaactctaggtaacgagtcgctacgtactaacgttacttatcgtacactacagtactaacttactttaccacgtaagtatactactaccgtccggacgtaacggaacacgacgtagaacgtaagttaaacgagtgtggtacncgaccgaacctagtcttgtaccttacg

SEQ ID NO: 172435 - DNA, 726 bp, Homo sapiens
  misc_feature: GYAE6OF02IL4P5.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctgggttccagcctcgaggggtnaaattgtgctgactcagtctccagtactttcagtctgtgactaccgaaaggagaaagtccaaccatccaccgtggccgggaccagtcacggacggtcggtttaggtaagtagtccttacacgtcggtaccagtcagaagccaggtcagtcctaccaaaagccttacctcgtaactacgtaaagttacgttaccggtaccttaccccgtagtttcccctttcgtaccggtaccggggttcccccttagggtaacggtttccgaggttcggaccgtaggtcggtacgttcgtacggggacctaacgtactttaccaacccgtacacctaagtaccaagtacgtaccgtaggaacgtcgtaaggaagtacgtgtacgtacgaacttaactttacgttacgtcgttacacgttacgaagttacgttaaccttaactttacccgtattaacggtacgtacgttacccgttaccgttaccgggaccgaaacgggacctaaccggtacgaacggtacgtaaaccgttaaacgcgtttacggacgttaccgtacgtaccctaactacgttccttacggttccttaaccg

SEQ ID NO: 172436 - DNA, 715 bp, Homo sapiens
  misc_feature: GYAE6OF02H2KPI.27.78.H01.1.454.CMB.1.raw
  modified_base (292)..(292): a, c, t, g, unknown or other
  misc_feature (292)..(292): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatccacctgccggcagtcagagcgttggagtagcttacactggtaccagacanaacgcaggtcagtcctaccaaagcctacctcactacaagtactcgtccttccctacgttcccttctacgtaccggggttcccctacggtacggttaccaggtcggctaggtcggacttacggtagggacctaccgtattttccccgacccctacaaccctaagtaccctaaagtacggtacccgttaagggaaacgtccgttaacggtaaagtacgtacggtaccgttacgtaacctaaaccgttttaacgttaccgttaggtacctaagttccgaaaggttaccgttaacctttaacccgttttaaccttacgtaaacggtttcgaaacctttcccgtaaccccggttaccgggtaaccccggtaaacggggtaccgtaaccggttaaccgaacgggttaacgtaaaccgtttaaaaaccgg

SEQ ID NO: 172437 - DNA, 638 bp, Homo sapiens
  misc_feature: GYAE6OF02GE8JT.27.78.H01.1.454.CMB.1.raw
  modified_base (517)..(517): a, c, t, g, unknown or other
  misc_feature (517)..(517): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcaggtctaccaaagcctcctacatacaagtatcgtccttccctacgttccttacgtcaccggggttcccctcggtaggttcaggttggacctaggtggtactcggtcgggaactactacgttttacccaacccttcaaccctatactaacgtacgccgtagggaaacgtctaaggaaagtagtcgaccgttagaacctaactttagttacctgtacctatacgaagtacttaaccgttactttaccganagttacgaacttccgtaccgttccggaacgtaacgggtacaaccgtagtacgggaataacggttaaaccggtagttggtaccggtctacggacccaacgtactcggttacgttccttaccg

SEQ ID NO: 172438 - DNA, 660 bp, Homo sapiens
  misc_feature: GYAE6OF02FVNRY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagcgttggtagtagccttacactggtaccagcagaagccaggtcagtctccaaagctcctcatcaagtatgcttcccagtcccttctcgacgggtcccctggacgttcagtggcaggtggatcgtgggactacgattttccaccctacaccaatccgaaatcggccctagggaaacgtccgttaaggaaacgtagttcggccgtaggtaccttaaactttactttacgttacggtactattaccgaagtacgttaaccttaacccttttacgtacgtaacggttacgtaccttacctaacccgtttacggaacccgtaaaggggtaccaacggtaccgtaagggtaacgtaaacgttaaaaccggtaaccgttaggttaccggtacgttcggtaccgtaacccgtaagttcccgtttagttacccgtttaccg

SEQ ID NO: 172439 - DNA, 804 bp, Homo sapiens
  misc_feature: GYAE6OF02GM6M0.27.78.H01.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcaggggtnaattgtgctgactcagtctccagtactttcagtctgtcgacctaccgaaaggagaacgtcaccatcaccgtcggcccgggccagtcaggaggtcggttaggtacgtacgtacttaacgaccgtacggtaccagacaggaacgccgaggtaccagtccacaagcctcctacgatacgaagtatcgtccttcccgtacgttcccttctccggacggggttccccgtacggtacggttccaggtcggtacgtaggttcggacgttcggtacgggtactacttacgtttaccccaccccgttctaacccgtaactacctaagtaccgtacccgttacgggaacggtaccgtaaggaacggtacttacggtaccgttacggtaaccctttaaacgtttaactttaccgttacgtttacctaacgtttaacgtaacggttaacgtttaacccgttttaaccgttttaaacccgttaccggttaaacggtttacgttaaccgtttaacccgttaacccggttacccggtaaacccgggaacgtaacccggtaaccgtaacggtacgggtaaacggttaaacgtttaaaccgggtaaccggtttacggtacggtacccgttacggtaacccgtaccgtacgtttacccgtttccgttaccccgg

SEQ ID NO: 172440 - DNA, 648 bp, Homo sapiens
  misc_feature: GYAE6OF02JRMJU.27.78.H01.1.454.CMB.1.raw
  modified_base (243)..(243): a, c, t, g, unknown or other
  misc_feature (243)..(243): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttaggtagtagnttacactggtaccagcagaacgccaggtacacgtcctaccaaagcctacctacactacaagtactcgccttccacgtccttctacgcgggtacccctgtacgttcagtcgcagtcgatcgtggactacatttccgacctacacctatactaacgtacgcctaggaaactcgtaggtaaagtacgttcgacgttagaaccttaactttacgttacgtagttaccgatacgtagtaaccgttacttacctttaacctacgtaacgtgtaacctaccgttaccttaccgggaaccgtaacgggtaacctaccggtaacgttaccgggaacgttaaacgttaaaccggaacttttaccgggaccggtacctcggtaacccctaacggtacgttaccgtacgtttacccg

SEQ ID NO: 172441 - DNA, 649 bp, Homo sapiens
  misc_feature: GYAE6OF02IJ4EM.27.78.H01.1.454.CMB.1.raw
  modified_base (525)..(525): a, c, t, g, unknown or other
  misc_feature (525)..(525): n is a, c, g, or t
tcagagcgtcgtctcacgaccggtgctcgatttagtgtgagtagtttggggtttggggggggcatgagcaaaactgacaagtcaaggcaggaagatgttgccatcacaactcattgggtttctgctgctctgggttccagcctccgaggggtgtaaattgtgctgactcagtctccagtactttcagttctgtgacctaccgaaaaggagaaagtcaccatccacctggcccgggccagtcagagtcgttggtagtagcttacacgtggtaccagcagaacgccgaggtcacgtctaccaagctcctcatcaagtatcgccttccacttccttcgtcgtacgggtcccctcggtacggttcgagtcggcaggtgtacgtcgtcgggactactacgtttaccaccctaccacctactacaactacgtcgtacggaagtctaggagtatgacgtagtacctaactttaacttacttcgtactactactaagttacgttaacctttaaccttaccttactaacgttanaccgttacgttaacccggttacggaaccggtaacggaccgaccgtacgtacgggaaacgttaacgttaaaccggtaacggtacgtcgggtacacgtaccgaccctacttccgttacgttacccg

SEQ ID NO: 172442 - DNA, 723 bp, Homo sapiens
  misc_feature: GYAE6OF02FVE5U.27.78.H01.1.454.CMB.1.raw
tcagagcgtcgtctcacgaccggtgctcgatttagtgtgagtagtttgggttggggactagagccaaaactggacaagtccaaggcaggaagatgttgccatcacaactcattgggtttctgctgtctcgtgggttccagcctaccaggggtgtaaattcgtgcctggactcagtcgtccagtactttcgagtctgtgactcgaaaggagaacgtcgaccatcgaccgtggcccggcagtcaggcgtcgttggtagtacgtcttaacagtcggaccagcgaggaagccgaggtcacggtctaccgaaagcctcgtcatactaggtatcgcttcccgagtccttctcgacgggtccctcgacgtcaagtcggacgagtagactcgtcggaacgtactacgttccaacccgtcaacctactaaccgtaactaccgccgtacgggtaacgtctaaggaaacgcgtacgtctacggtacctaacgttacttacggttacgtactaacgtacgaagttaccgttaacgttaacccgtttaccgtaacgtaacgttacgttaacgttacccgttaaccgtttaccgggaacccgtaaacgggtaccgtaaccggttacggtaaggtaacggttaaaacgtttaaaccggaaccgtttacgggttacggtaccggttacgtaacccgttaccggttaccgttcccggtacggtttacccgtttaacccgg

SEQ ID NO: 172443 - DNA, 684 bp, Homo sapiens
  misc_feature: GYAE6OF02JAQ6K.27.78.H01.1.454.CMB.1.raw
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggccagtcagagtccgttaggtagtacgcttacacgtcggtaccagcagaacgccaggtcagtctaccaaagcctcctcactacaagtactgtccttcccacgttccttcgtaccgtaccggggttcccctaggacgggtttcaggtggcctaggtggacttcggtagggacctacgtacttttcccgaacccttcccaaccgtaactactaaacgtacgacccgtaggtaaacgtacgttaggaaagtacgtcgtactcgtaacctaacgtttacttaccgttacgttaccgtattacgaaggttacttaaccgtttacctttaaccgtacctaaagttcgtaacctaccgttaccgtttacccggaaccggtaaacgggactaaccggtacgtaaggtacgtaaacgttaaacgtaaacgttcggtacggcttacgacctaacctagtttctacggttcttaaccg

SEQ ID NO: 172444 - DNA, 731 bp, Homo sapiens
  misc_feature: GYAE6OF02HZLFR.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtgaaattgtgctgactcagtcctccagtactttcagtctgtgactaccaaaggagaaagtcaccatcacgtggccggccagtcagacgtcgttggtagtagacttacacgtcggtaccagacgaagaacgccgaggtccacgtcctaccaaagcctcctcactacaagtactcgacctttcccgtacgttccctttccgtaccggtaccggggttcccctcggttaacggttccgtaacgggttcggacgttagggtacggtacttccggtaggggaacccttaccgtacgttttacccaacccctacctaaccgtaacttaccgaaacttaccggtaccgtaaggaacgtacgtacggaaagtagtcgtacgttacgtaaccttaaactttactttaaccgtcgttactacgttcggaaacgttaccgttaaacctttcccgtttaaccctagttaacggtcttaccgtacccgttacccggttacccggaaccggtaaaccgggtaaccgaaccggttaaccggtaagggtaacggttaacgttaaaaccgg

SEQ ID NO: 172445 - DNA, 674 bp, Homo sapiens
  misc_feature: GYAE6OF02GFBHJ.27.78.H01.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcactgccggcagtcagncgttggagtagcttacactggtaccagcagagccaggtcagtctccaaagctcctcatcaagtactgccttcccagttcccttctcgtacggggttccccctacggtacggttcaggttcggactaggtcgggactcgtgggaacctacgacttttccgaccccttcaacccagttccaaatacgtccttagggaacgtctaggaaagtagtagtcctaggtacctaaacctttaattaccgtcgttactaatcctaaagttaccggttaaccttacgtttaaccctacgtaaagttcgaacttacccgtaacccgtttccgggaaccgtaaggggtaaccctacggttacccgtagggtaaaccgttaaacggtttaaaacccgtaacgttacggttacggacgttacgggaccctaaacccgtattacccgttaggttacccttaccc

SEQ ID NO: 172446 - DNA, 818 bp, Homo sapiens
  misc_feature: GYAE6OF02GJS6E.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagtcctccgaggggtagaaattgtgctgactcagtcctccagtactttcagttctgtgactaccaaaggagaacgtcaccatccaccgtcggccgggccagtcagagcgttgtagtagtcttacgactggtaccagacagaacgcgaggtcagtccgtaccaaacgtcctcctacactacgtaagttatccgtacctttaccccgtacgtttccccttaccgtaccggtaacccgggggttccccccgttcgggtaacgggttttcggtacgggttcgggtcgtaacgggttcgggtaacgttcggtagggggaaccctaaccgtttaactttcccctaaccccgttaccgaaccctaactaccgtaaacgttaaccgccggttacgggtaaacgtccggttaaaggaacgtagtacggtaccttaacggtaacctttaaacttttaacgtttacgtacggttactaaacgtttaacgaaacggttaaaccttttaacccttttaacccgttttacccaaggttaaacccggttcgttaaacccgttacccgttaaccccggtttaaccccgggaaccggttaaaccggggtaccgtaaaccggttaaccgggtaacgggttaaaccggttaaaaccggtttaaaacccggg

SEQ ID NO: 172447 - DNA, 677 bp, Homo sapiens
  misc_feature: GYAE6OF02FHFNR.27.78.H01.1.454.CMB.1.raw
  modified_base (179)..(179): a, c, t, g, unknown or other
  misc_feature (179)..(179): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggttctgctgctctgggttccagcctccaggggtnaaattgtgctgactcagtctccagactttcagtcctgtcgactccaaaggagaaacgtcaccatccacctcggccgggccagtcagagcgttggtagtcgacttacacgtggtaccagcagaagccaggtcagtcctacctaaacgctccctacaatcaagtactgccttcccagttcccttctcgaccgggggttcccctacggtacggttcaggtcggcagttcggactcgagggactacactttccaaccccttccaaccactactaaactacgcccgttagggaaacnccgttaggaaaacgtgtcgacgttacgtacctaaacctttaattaaccgttggttaaccaagttaacctaaacgggttaactttaacccttaaccttttaacccgtacaaacgggtttacaacttaccccgtaacccgtttacccggaaccgtaaaccgggtacccaaccggtaaccgtacgggtaactaaacgttaaaaacccgg

SEQ ID NO: 172448 - DNA, 702 bp, Homo sapiens
  misc_feature: GYAE6OF02GQVVD.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccaaaggagaaacgtcaccatccacctcggcccgggccagtcagagcggttggtagtgacttacactcggtaccagcaagaacgccgaggtccaggtcctaccaagcctcctcatacaagtactcgccttacctagtccttccgtccgacgggtcccctgtacggttacacggtgcgtagtcggtatcggtaggactactacttacccaccctacacctactacaactacgtccgtaggaacgtcgtaggaagtacgtacggtacgttacgaaccgttaaacctttagttaaccgttggttactaacgttaccgaaacgttaacgttttaacccttaaccttttaacccgtacgtaagtttacgaaccttacccgttaccgttaccgggaacgaaacgggtacccgtaacggtacggtaggtaaaacgttaaccgttaaaacggtacggtaacggttacgttaccgtacggtaccctaaacgttaccgttaccgtttcgtacccgtttacccg

SEQ ID NO: 172449 - DNA, 664 bp, Homo sapiens
  misc_feature: GYAE6OF02JHGTS.27.78.H01.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgactcaaagganaaagtcaccatccacctgccggccagtcagagcgttggtagtagcttacactggtaccagcngaagccnggtcngtctccaaagctcctcatcaagtntcgcttcccagtcccttcgtaccgtacggggttccccctggtaacggttctaacggtcggtccgaagggttacggacgttcgtaggggtaccctactaccggttttacaccccctacgtaccccgtaaatctaaacgttccgtaccgttcgggaaacgtcgtacggtaaagaacgttcgagttcggacttaaacgtttacttaaaccggtctacctacgtctaaagggttaacttaccttaacctttaccgtacgtaacgtacgttacgtacctaccggttaccggtacccgaacggttaccgaaccggttataacgggtaataaccgtttaaacgg

SEQ ID NO: 172450 - DNA, 762 bp, Homo sapiens
  misc_feature: GYAE6OF02IA76E.27.78.H01.1.454.CMB.1.raw
  modified_base (149)..(149): a, c, t, g, unknown or other
  misc_feature (149)..(149): n is a, c, g, or t
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgtgccatcacaactcattgggtttcngctgctcgtgggttccagcctcgaggggtnaattgtgctgactcagtcctccagtactttcagtctgtacgactaccgaaaaggagaaacgtcaaccatccaccgtggcccggcagtcaggaggtcggttggtagtacgtacttacgacgtacggtaccagacaaggaacgccgtaggtccagtacctaccaaagtcctacccgtataactactaagtactcgtccctttacccgacgtttccccttcgtacccggtaccggggtcccccttagggtacggttacgtaacgggtcggtacgtagggttacggtacgtttccgggtacgggtaacctaccgtttaccgtttacccctaaccccgtacctaacctaaccgtaacgtaaacgttaccggtaccgtaacggtaacgtaccgtaaggaacgtacgtacgtaccgtagtaaccttaacgtttacttacgttgtaacctagtacgtaacgttaaccgttaaccgtttaacctttaccgtaactaacggtacgtaaccttacccgtacccggttaaccggaaccggtaacgggaccgtaaccggttaacggtaacggttaacggtaaccgtttaaaccggg

SEQ ID NO: 172451 - DNA, 584 bp, Homo sapiens
  misc_feature: GYAE6OF02J0532.27.78.H01.1.454.CMB.1.raw
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (377)..(378): a, c, t, g, unknown or other
  misc_feature (377)..(378): n is a, c, g, or t
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctagactcagtcctccagtactttcagtctgtgacctaccgaaaggagaaagtcaccatcacctggccggaccagtcagagcgttggtagtagtctacacgtggtaccagcagaacgcagtcagtctcaaacgctcctnatacaagtntcncttccactcttacncgacgggtccctgagttcagtcgnngtgcgtcgnggactactacttccacccgtcactactacaagtactacgtgaacgtctacgaagactgtccgtnaaccgttaattacgttactacgtcgtaatacgtacgacgttaacttaccgtttactacgtaacgtggtacctaccgttaccgttacccggagtaaccggacgtaccgtagtacggtaactaacgttaaaccgg

SEQ ID NO: 172452 - DNA, 823 bp, Homo sapiens
  misc_feature: GYAE6OF02IFXE7.27.78.H01.1.454.CMB.1.raw
  modified_base (149)..(149): a, c, t, g, unknown or other
  misc_feature (149)..(149): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaattgtgctgactcagtctccagtactttcagtctgtgactcaaagganaagtcacatcaccgtgccggcagtcagagcgttggtagtagcttacacgttggtaccagacaagaacgccgaggtcagtcctaccaaagtccttcctacactactaaaggttactcgtaccctttccctaacgttccccttttacgtccggtacccgggggttccccttacgggtacggtttcctaagggtcggtacgtagggttcgggtacgttcggtacgggtacctaacgttaaccgttttccccaaaccccgttacctaacccgtaacgttacccgtaaaacgttaccggtacccgttacgggaaacgtccggtaaaggaaagtacgttacgtaccgttacggtaccttaaaccgttttaacgtttaaccgttacgttaaccgtagttaaccgtaacggtaaccgtttaaccttttaaccgttttaacccgtaccgtttaaacggttacgttaccgtttaccccgttaaacccggtttacccgggaaaccggttaaacgggtaacccgtaaccgggtaacgttaggggtaaacgttaaaccgtttaaaacggtaaccgtttacggtacggtaccgttaccggtaacccgttaaccgttacgttcccgttacggtttacccc

SEQ ID NO: 172453 - DNA, 598 bp, Homo sapiens
  misc_feature: GYAE6OF02HDDMX.27.78.H01.1.454.CMB.1.raw
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggccagtcagagcgttggtagtagcttacactggtaccagcagaacgcaggtcagtctaccaaagctctcatcaagtatcgtccttcccagtccttctcgacggggtcccctcggtacggttcaggtggcaggtcggatcgtcgggactacgtactttcaccctcaccatacaagtacgccgtaggacnctagaagntcgctcgactaaccttattagttcgtactagtacaagtacgttaacctttacctttacctactaagtgttacttacctaacccgttcggaaccgtaacgggacctaaccgacgtaggtaaggtaacgttaaacgtacgtaggttacggccgtacgaccgtaaccacgtttaccgtgtttaccttccg

SEQ ID NO: 172454 - DNA, 621 bp, Homo sapiens
  misc_feature: GYAE6OF02HV5ZQ.27.78.H01.1.454.CMB.1.raw
  modified_base (455)..(455): a, c, t, g, unknown or other
  misc_feature (455)..(455): n is a, c, g, or t
tcagagcgtcgtctcacgaccggtgctcgatttagtgtgagtagtttgggtttggggggcatgagcaaaaactgacaagtcaaaggcaggaagatgttgccatcacaactcattgggtttctgctgctctgggttccagcctccaggggtgaaattgtgctgactcagtctccagactttcagtctgtgactccaaaagggagaaagtcaccatcaccgtgccggccagtcagagcggttgtagtagcttacacgtggtaccagcaagaagccgaaggtcagtctaccaaagctcctcatacaagtatcgacttcccagtcccttctccgacggggtcccctggaggttcgagtggcaggtgatcgtgggactacactttcacccctcacctatacaagtacgcctgggaatctagaagactgctagacctaaacttagttaaccttggtacctnttacgaacggtattaaccttaacctttaaccacgtaagttacgaacttaccgtacccgttacggaacccgtaaggacccgacggtaactaggggaacgtaaacgttaaaccggtaaccgttggtacggtacttggaaccccttacgtaacttaccgttgttaaccc

SEQ ID NO: 172455 - DNA, 549 bp, Homo sapiens
  misc_feature: GYAE6OF02FKHJG.27.78.H01.1.454.CMB.1.raw
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggcagtctcaaagctcctcatcaagtatgcttcccagtccttctcacggggtcccctcgaggttcagtggcaggtggatcgtgggacactatttcaccctcaccatcaatacgcctaggaagctgaanatgctgacaacttattactgtacatcagtacgtacttactttacctactaagtgactcctaccgtttcggacctaagggaccacgtacgtaggaagtaacgttaaacggaacgtggtacggcttacggacctacctattcttacgttcctttacc

SEQ ID NO: 172456 - DNA, 707 bp, Homo sapiens
  misc_feature: GYAE6OF02IUOEH.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccaggggtnaaattgtgctgactcagtctcagtactttcagtctgtgacctccaaaggagaaagtcaaccatccacctgccgggccagtcagagtcgttaggtagtacgcttaacactggtaccagcaacgaagccgaggtacaggtcctaccaaagtcctcctcactactaagtactgtccttcccacgtccttcgtaccgtaccggggttcccctcggtaggtttcacggttggacgtaggtgggactttcggtacggggaacctacgtactttacccaccccgttacacccaattaccgtaaactacggtaccgtaagggtaaccgtacgtacggtaaacgacgtacgacgtcggtaaaccttaacgtttaacgtttaacgtcggtaactaacgttaacgaagttaaacgttaacctttaacctttacccgttaacgttaaacggttacggtaacctttccgtaacccggttaccggaaccggtaaacggaccgtaaccgtaacggtacgggtaacgtaacgtttaaaaccgg

SEQ ID NO: 172457 - DNA, 692 bp, Homo sapiens
  misc_feature: GYAE6OF02FMXJZ.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtagtaattgtgctgactcagtcnccagtactttcagtctgtcgactaccaaagggaagaaacgtccacctatccaccgtacggccgggccagtcagaggtcgttaggtagtagacttacacgtcggtaccagcgagacgccgagtcagtctaccaacgcctcctcactacaagtactcgtccttccctacgttcccttccgtaccggtaccggggtcccctcggtacggtttacgaggtcggacacggtggtacgttcggtacggactaccttacgtttacccacccttacgaacctatacctaactacggtaccttaggaacgtcgtacgtaagcgtcgtacgtacgtactaaacgtttactttaccgttagtaccgttaacttacggtaaacgttaccgtttaaccgtttaaccgtttaccctacgtaacgttcgtaacctacgttacccgttacggaaccggtaacgggacctaccgggtaacgtacgggtaacgtaacgttaaacccgg

SEQ ID NO: 172458 - DNA, 665 bp, Homo sapiens
  misc_feature: GYAE6OF02GR0DC.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaagtcacatcacctgccggccagtcagagtcgttggtagtagtcttacactggtaccagcagaagccaggtcagtctaccaaagctcctcatcaagtatcgccttcccagttcctttcgccgtacgggtccccctaggtacggttcaggttggctaggtggatcgtgggaactactagtttaccaccctacaaacacttaccgaataacgtccgtaggtaacgactacggaaagtacgttcgacgttacgtacctaacttttacgtaccttagtacctacgtacgaagtacgttaaccttacctttaaccgtacgtaagtcgtaacttaccgtaacccgttccggaaaccgtaaagggtaccctaaccggtacgttacgggtaacgttaacgtttaaaaccggtacggttaacggtaccggtaccgtacggtaccctaccgtacgttaccgttacgttacctttaacccg

SEQ ID NO: 172459 - DNA, 713 bp, Homo sapiens
  misc_feature: GYAE6OF02JXHKJ.27.78.H01.1.454.CMB.1.raw
  modified_base (390)..(390): a, c, t, g, unknown or other
  misc_feature (390)..(390): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggggcgatgagcaaaactgacaagtcaaggcaggaagatgttgccatcacaactcattgggtttctgctgctctggttccagcctccgaggggtgaaattgtgctgactcagtcctccagtactttcagtctgtgacctaccgaaaaggagaaagtccaccatccacctggcccggccagtcaggaggtcgttggtaggtacacttacacgtcggtaccagcaagaacgccgaggtaccacgtctaacccaaagtcccttacccacgtaagtacaaaggttctccgacctttccccgtacgttcccgtttccgtccggtacccggggttcccccncgggtaaggtttcaaggttcggctacgggtagggtactcggtgggaacctacgttacttaccgaacccctccgaaccctataacctaacgtaccgtaccggtaacggtaaggtaaccctaggaaacgngtacggtcgtacgtaacttaaatttaccgtttaatcgtaactacgtactaaggtaaccttaccctttaactttacccgtgtaaacgtcgtaacctctaacccggtacggaaccgtaacgtaccgacgtaggttacggaacttaaagttaaccgaacgttggtacgtcacgtacccaacttcgttacgtcttaccg

SEQ ID NO: 172460 - DNA, 792 bp, Homo sapiens
  misc_feature: GYAE6OF02J0Y9A.27.78.H01.1.454.CMB.1.raw
  modified_base (304)..(304): a, c, t, g, unknown or other
  misc_feature (304)..(304): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccaggggtgaaattgtgctgactcagtctccagtactttcagtctgtcgactaccgaaaggagaaacgtccaccatccaccgtggccgggacctagtcagagtcggttggtacgtagtcttacactggtaccngacaggaacgccgaaggtcacgtaccgttaccgaaacgtctaccctctaactacaacgttatcggtaccttacccgacgttcccttctaccgtaccgggggttcccccttagggtaacggtttacgacggtcggtacgtacggttacggactttcggtacgggtaacctaacgttaccttttacccacccctactaacccgacttaacgtaaccgtttacgacccggttagggtaaaccgtacgttaacgaacggttacgtacggtacccgttacgaacctttaaaccgtttaacggtttaacccttaggttaacctaacgttaccgtaaacggtaaccggttttaaccctttaacccgtttaccgttaacgtaaacgggttcttaaaccggttcccgttaaaccccggtttaccggtaaacccgggtaacgggttacccgaacccgggtttacggtaacgggttaaccgttaaacggttaaaaccgg

SEQ ID NO: 172461 - DNA, 660 bp, Homo sapiens
  misc_feature: GYAE6OF02H8UTA.27.78.H01.1.454.CMB.1.raw
  modified_base (246)..(246): a, c, t, g, unknown or other
  misc_feature (246)..(246): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactccgaaaggagaaagtcacatcacctgccgggcagtcagagcgttgtagtagtcttanacgtggtaccagcagaagcgaggcaggtctacaaagcctcctacactacaagtatcgtcttccacgttccttctcgtaccgggtccctcgtacggttcaggtcggcgtaggtggtacgtcgtaggggactaacgttactttacccgacccctcgaacctataccaataccgccgtaggaacgtctaggtaagtagtgtcgtacgaactaacttaacttacttcgtactactcgtaagtacgttaaccttactttaaccctaagtaacgttcgtaaccttacccgttaaccgttaccggaccggaaacgggtacctaaccggtaacgtacgggtaacgtaaacttaaaccggtacgtacggtaccggtagtaccgtaaccgtacctaaccggtttcttaccgttacgttaacccg

SEQ ID NO: 172462 - DNA, 718 bp, Homo sapiens
  misc_feature: GYAE6OF02JDVD9.27.78.H01.1.454.CMB.1.raw
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccagtactttcagtctgtgactaccaaagganaaaagtcaaccatccacctggccgggccagtcaggagtcggttggtagtagcttacacgtcggaccagccaaggaacgtcccgaagggtccaggtccttacccgaaagtcctcctcacttcaaagtatcgccttcccacgtcctttcctcgtaaccggggttcccctcggtacggtttccgaggttggcctaggtggaacgttcggttacggggaacctacgttacttttacccgaccccttacaccctaattaccaaacgttacggccgttagggaaacgtaccgttaaggaagtacgtgtactacgtaaccttaacgtttacttactcgtactatcgtaagttacgtaacctttaccttacctactaaggttactacgttaccgtaaccgtttccgggaaacccgtacgggaacctaccggtaacgtacgggtaacgttaaacgttaaaaccggtaacgttacgggtacgtaccgtaccgtacctaaccgttacgtactttacggtcctttaacccg

SEQ ID NO: 172463 - DNA, 693 bp, Homo sapiens
  misc_feature: GYAE6OF02JQEW6.27.78.H01.1.454.CMB.1.raw
  modified_base (145)..(145): a, c, t, g, unknown or other
  misc_feature (145)..(145): n is a, c, g, or t
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtnaaattcgtgctgactcagtctccagtactttcagtctgtgactccaaagngaaatcaaccatcacctgccgggacagtcagngcgttggtacgtagccttacactacggtaccagcaagaagcctaggtcagtcctacaaagctcctanatcaactatcgcctcccgattcccgtctccgacggggtcccccttggtacggttcaacgggttcggaccgtacggttggtaacgttccggtagggaccctacggttactttaccaaccccttccgacctaaacgttctaactaacgtccctaggtaacgtcgtaacggtaaagacgtgacctacgtaccgtaactttaacttccgttaagttccgttaactaacgacttaaccggtaaccttacccgttttaacctaacgtaacgttacgaccttaccttacccgttccgggaacctaaaccggggtacaaccggtacgtaggtaacgttaaaccggttaaacgtacgttccgtacgggtacccttcgaccgtacctacgtacgttacgtaccttaccg

SEQ ID NO: 172464 - DNA, 568 bp, Homo sapiens
  misc_feature: GYAE6OF02IJB3W.27.78.H01.1.454.CMB.1.raw
  modified_base (200)..(200): a, c, t, g, unknown or other
  misc_feature (200)..(200): n is a, c, g, or t
  modified_base (417)..(417): a, c, t, g, unknown or other
  misc_feature (417)..(417): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgcccgggccagtcagagcgttggtagtagcttacactggtaccagcagaagccaggtcagtctccaaagcctcctcatcaagtatgccttcccagttccctttctccgtacggggtccccctacggtaggttcaggtcggcaggtggatcgtgggacacactttccaccctcaccatacaatcgcctaggaagctagaagntgctgactaattattactgtctatcagtatacttaacttacctctaagtnatcctaccttccggaccgtaagggaccacgtacgtaggtaactaagttaaaccgaacttggtacggtccgtacgacctaccgtacttccgtacgttacccg

SEQ ID NO: 172465 - DNA, 660 bp, Homo sapiens
  misc_feature: GYAE6OF02G1BQ0.27.78.H01.1.454.CMB.1.raw
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagccctccaggggtgaaattgtgctgactcagtctccagtactttcagtctgtgactaccgaaaaggagaaagtccaccatccacctgccgggccagtcagagcgttggtagtagcttacactggtaccagcaagaagccaggtccagtccaccaagcctccgtcatcaagttancgtcctcccagttccctctcgacggggtccctgtacggttcagtgcagtgntcgtgggacactcttccaccctctaccactacaactacgacccgttagggaaactcgtaacggaaagtcttcggaccttacgaaccttaaacgttttacgtaacgtttagtaccgtacgttaccgtaaacgttaacgttaacctttaaccttttacccgttacgttaaacggtcgtaaccttacggttaaccccggtttaccggaaccccggtaaacggtacccggtaacgttaacgggtaaccggtaaggttaaaccgttaaaaccgg

SEQ ID NO: 172466 - DNA, 568 bp, Homo sapiens
  misc_feature: GYAE6OF02F71DF.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggngaaagtcaccatcacctgcccgggccagtcagagcgttggtatagcttacnctggtaccagcagaagccaggtcagtctccaaagctcctcatcaagtatgcttcccagtccttctcacgggtcccctcgaggttcagtggcagtgatcgtgggacactatttcacccttcaccatcaatagcctggaancgtagaagatgctgactaacttattactgtctatcagacgttaccttactttacctactaagtcgacttacctaccgtttaccggacccgtaaagggtaccaaccggtacgtaggaacgtaaacgttaaaccggaacgttggtacggtcttacggactaaccgtactcttcggtcctttaccg

SEQ ID NO: 172467 - DNA, 583 bp, Homo sapiens
  misc_feature: GYAE6OF02IUSYK.27.78.H01.1.454.CMB.1.raw
  modified_base (147)..(147): a, c, t, g, unknown or other
  misc_feature (147)..(147): n is a, c, g, or t
  modified_base (250)..(250): a, c, t, g, unknown or other
  misc_feature (250)..(250): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagagcgtcgtctcacgaccggtgctcgatttagtgtgagtagtttggggtttggggatgagcaaaactgacaagtcaaggcaggaagatgttgccatcacaactcattgggtttctgctgctctgggttccagcctccaggggtnaaattgtgctgactcagtctccagtactttcagtctgtgactcgaaaggagaagtcaccatccactcggccggccagtcagagtcgttaggtatacgcttacncgtcggaccagcagaagccgaggtcacgtcctaccaaagtctccgtacactactaagtatcgtccttcccacgtcctttctccggtaccggggtcccctcggtaggttcacggtggacagtggagtcgtggacacgtnttccacctcaccntacatcgccgtaggacncgtagaatctgtcgtacgtacttaactttacttacgtgtcagtctaagtactacttacttacctataagtcgtactcgtaccgttacggacgaacggactacgagtacggtaagttaactaacggatcggtacgtcgtgacctaccgtctcgttagttcctaccg

SEQ ID NO: 172468 - DNA, 879 bp, Homo sapiens
  misc_feature: GYAE6OF02HMR6D.27.78.H01.1.454.CMB.1.raw
tcagagcgtcgtctcacgaccggtgctcgatttagtgtgagtagtttgggtttggggatgagcaaaactgacaagtcaaggcaggaagatgttgccactcacaactcattgggtttctgctgctcgtggttcagcctccaggggtgaaagttgtgctgactcagtctcagtactttcagtctgtgactaccgaaaggagaaagtcaaccgataccaccgtggaccgggaccaggtccgagagtcggtttgggtaaggtacgtcttacgacgttacgggtaaccaggtacaaggtaacgccctagggtcctaacgttccttaaccgaaaacgtccttccgtacgtactaccgaaaggttactaccggtcctacccgtaacggtttcccctttccgtcggtaaccgggggttcccctacgggtacggtttcgaggttacgggaccgtaggtcgggactttcggagggtaacctaaccgttattttaccaacccttacaaccgttaacgttaccaaaggtttacccgaccggttacggaacgtaccgttaaggaaacggtagtacggtaacctacggtaaccttaaacgttttaaccgtaaccgtttacggtaaccttaacgttaaccgtaaacgtaacgtttaaccgttttaaccgttttaccctaaggttaaacggttacgtaacgttaacccgttaacccggttaaccggtaaacccgggtaaaacgggtaacccgtaacgggtaacccggttacgggttaaacgttaaaacgtttaaacccgggttaaacggttaacgggtaccgggtacccggttaacgggtaacccgttaaccgttaaccggttttacccgtttacggttttccctttaacccggg

SEQ ID NO: 172469 - DNA, 717 bp, Homo sapiens
  misc_feature: GYAE6OF02GEAQO.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgtgccatcacaactcattggttctgctgctctgggttccagcctccaggggtgaaattgtgctgactcagtctccagactttcagtctgtgactccaaaggagaaagtcaccatcacctcgccggccagtcagagcgttggtagtagcttacactggtaccagcaagaagccgaggtcaggtcctaccaaaagctccctacatacaaagtatacgccttacccacgttacccttctccgaccggggtcccctacggtacggttccgagtcggctacggttcggacgttcgtacggggaacctaactcgtttttacccaaccccttacctaacccgtaactcctaaaacgtacggtacccgtagggtaaacgacgttaggaacgtaacgtggtacctacgtaccgtaaactttacgttaaccgtttacgtaccacgttaacccgtaagtaaaccggttaacctttaaccgttttaaccctaacgtaaacggttcggtaaccttacccggtaaccccgtttaccgggaacccgttaaacggggtacccgtaaaccggtaacggtttaccgggaacttaaccggtttaaaaaccggg

SEQ ID NO: 172470 - DNA, 789 bp, Homo sapiens
  misc_feature: GYAE6OF02HZ4D6.27.78.H01.1.454.CMB.1.raw
  modified_base (263)..(263): a, c, t, g, unknown or other
  misc_feature (263)..(263): n is a, c, g, or t
tcagagcgtcgtctcacgaccggtgctcgatttagtgtgagtagtttgggtttgggggatgagcaaaaactgacaagtcaaggcaggaagatgttgccatcacaactcattgggtttctgctgctctgggttcagcctccgaggggtgaaattgtgctgactcagtctccagtactttcagtctgtgactccgaaaggagaagtcaccatcacctggccggccagtcgagagcgttggtagtagtcttacactcggtaccagngagaacgcgaggtcagtctaccaagtctcctactatactaagtatcgtccttcccgtacgttccttcgccggtaccgggttcccctggtacggttacgtggtcggtacgaggtacgtacttacggacgggtactaccgttacgtttacccaccccgttaccaacctaactaccgtaaagtacccgtaccggtaaggaaccgtacggtaagggtaaacgtaggttacgtaccttaggaacccgtttaaacctttttactttaaccgtttcggtaacctacgtttaaccggtaaccggttaacttttaacccggtttttaaccctttaacccgttaacgttaaacggtttaccgttaaccgttaccccgtttaacccgggtttacccggggaaacccggtaaaccggaccggttaaccggtacggttaacgggaaacgttaaacggtttaaacccggttaaggttacggacggttaccggtaccgaccgttaccgttaacgttaccgtttaccgttcctttaacccgg

SEQ ID NO: 172471 - DNA, 709 bp, Homo sapiens
  misc_feature: GYAE6OF02IEAC9.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcacatccacctggccggcagtcagagtcgttggtagtagcttaactactggtaacccagacgaaggaacgaccgtaggtcaacggtcctaccgtaaaacgccttacccgtcgaagttactaaacggttaatcggaccctttcccgtaaccgtttcccgtttccgtaccggtaacccggggggttaccccccttagggtaaacgttttcgaacgggttaggacccgtaaggtcggtaacttccggtacggggaactacgtaacgttttccaacccctaccgtaacctacgtactaaacgttaaccgccgttaacggaacgtccgtaggaaactagcgaccgttagaccgttaaactttataccgtacgttactacttacgaattaacgtacttaaccttaccgtacaacgtcgtactacctaccgtttacggaccgtaacgggcaaccgtacggtacgtaagtacgttaaaccgg

SEQ ID NO: 172472 - DNA, 633 bp, Homo sapiens
  misc_feature: GYAE6OF02FRHMB.27.78.H01.1.454.CMB.1.raw
  modified_base (177)..(177): a, c, t, g, unknown or other
  misc_feature (177)..(177): n is a, c, g, or t
  modified_base (227)..(227): a, c, t, g, unknown or other
  misc_feature (227)..(227): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcagggtnaattgtgctgactcagtctccagtactttcagtctgtgactccaaagganaaagtcacatccacctggccggcagtcagagcgttggtagtagtcttacactggtaccagacagaacgccgaggtcagtcctaccaaagcctcctcaatacaagttatcgccttacccagttcccttcgtcgaccggggttcccctggtacggttcaggtcggctaggtggtactcggtcgggaactacgtactttcccgaaccctctaccgtatactaacgtacggaccgtaggaacgtacgtaggtaaactacgtcgtacctaggtaacctaacgtttacttacgttcgtactatacgtaagttaacgttaccttactttacctacgtaagttctaacttcccgtaaccgttacggaaccgtaacgggacctaccggacggtacggtaagtaacgttaaaccgg

SEQ ID NO: 172473 - DNA, 574 bp, Homo sapiens
  misc_feature: GYAE6OF02FMPGG.27.78.H01.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (452)..(452): a, c, t, g, unknown or other
  misc_feature (452)..(452): n is a, c, g, or t
  modified_base (568)..(568): a, c, t, g, unknown or other
  misc_feature (568)..(568): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaatttgtgctgactcagtctccagactttcagtctgtgactccgaaaggagaaagtcaccatcacctggccgggccagtcagagcggttggtagtacgctttacactggtaccagcagaagccagtcagtctcaagctctcanacaagtntgccttccacgttccttcgtcgacggggttcccctggtacggttcagtggcagtggtatcgtcgggacactacttccacccgtcaaccatacaactacgcctaaggacgtcgtagaagtatgactagactaacttattactcgttcacgtanagtaacgttaacttaactttacctataacgttcacttacctaaccgtcggaccgaacggactacgcgtaggaacgtaacttaaaggacgttagtgacgtcgaccgtactctcgttnttaccg

SEQ ID NO: 172474 - DNA, 733 bp, Homo sapiens
  misc_feature: GYAE6OF02FM9CP.27.78.H01.1.454.CMB.1.raw
  modified_base (164)..(164): a, c, t, g, unknown or other
  misc_feature (164)..(164): n is a, c, g, or t
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatgagcaaaactgacaagtcaaggcaggtaagatgttgcatcacaactcattgggttctgctgctctgggttctaggcctccgaaggggtgtaattgtgctgtactnagtctcagactttnagtctgtgactaccgaaaggaggaaagtcaaccatcaccgtggccgggccagtcagacgtcgttaggtagtagcttacacgtggtaccagctagaagccaggtcagtctccaaagcctccgtacacgtacaacggtatgaccgttcccgaagttccgtttcgtcgacggggtccccttggtacggttcgtagtggacgtaggtaggtacttcgtaggggtactacgtagtttcccaacccttccgaacctacgtaaccgtaaacgttacgtaccgtaaggtaaacgtcgttaacggaagtaagtacgaccgttacgaaccgttaaaccttaactttaacgttacggtacttaacgttaccaagtaacttaaccgtttaactttaacccgtaacgttaagtacggtaacttaccgttaaccgtttaccggaaaccggtaaacgggtacgtaaccggtaacggtagggtaaacgtaaacggttaaaccggaacgttacggtacggtacgttacgtaccgtaacccgtacgttaccggtaccgttaccgttaacccgg

SEQ ID NO: 172475 - DNA, 565 bp, Homo sapiens
  misc_feature: GYAE6OF02HDJLS.27.78.H01.1.454.CMB.1.raw
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (509)..(509): a, c, t, g, unknown or other
  misc_feature (509)..(509): n is a, c, g, or t
tcagagcgtcgtctcacgaccggtgctcgatttagtgtgagtagtttgggtttggggatccttaaaagaggttctttctctgggatgtggcagtgagcaaaactgacaagtcaaggcaggaagatgttgccatcacaactcattgggtttctgctgactctcgggttccagccctccgaggggtgaaattgtgctgactcagtctccagtactttcgagtctgtgactaccgaaaggagaaagtcaccatcacctgccggcagtcagagcgttggtagtagctacacgtggtaccagcagaagccgaggtcagtcctacaaagtcctcctcatacaagtatcgcttcccagttccttactcgtacgggtcccctggacgttcaggtcgactagtcggatcgtaggacactacgtttccaccctcaacgntacatgctcgtaagcctagaacgctagctcgactaacttntactgtacntacgagtacttacttacttaccagtaacgtnactccgtaccgttaccggacgtacgggacaccggtagtacggactaagtaaaccgg

SEQ ID NO: 172476 - DNA, 520 bp, Homo sapiens
  misc_feature: GYAE6OF02FU7CU.27.78.H01.1.454.CMB.1.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagagccaggtcagtctccaaagctcctcatcagtatgctcccagtccttctctagggtcccctgaggttcagtcggcagtggatcgnggacacatttcacctcaccntcaatacgcctagaacnctagaagatagctgactaactattactgtcatcagtagtacttacttaccctnaagtgaatcaccttcgaccgaaggcacgtcgtagagtagtaaccgtactgtacggactcggtaccaccgtatccttacgtcttaccg

SEQ ID NO: 172477 - DNA, 682 bp, Homo sapiens
  misc_feature: GYAE6OF02II76R.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagcgttggagtagcttacacgtggtaccagcagaaagccaggtcagtctaccaaagctcctcatacaagttatcggcttccctagttccctttcgtccgtacggggttccccctcggtaggttccaggtggccgtaggtggattcgtaggggacctacgtactttcccgacccctaccaaccctataccaaagttccgtaaccgtagggaacgaccgtaggaaagtacgtagtctacgtaaccctaaacgttttaacttaacttcgttactataccgtaaagtacggttaacctttaacgtttaaccctacgtaacgttcgtaacttcccgtaacccgtttaccgggaacccgtaaccgggtaacctaaccggtacgtaacgggtaacgtaaacgttaaaccggtaacgtcggttacgaccgttcgaacctacccgaatttctcgttaccgttaccg

SEQ ID NO: 172478 - DNA, 629 bp, Homo sapiens
  misc_feature: GYAE6OF02HC7CH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtgaaattgtgctgactcagtctccagtactttcagtctgtgactaccgaaaggagaaacgtcaccatccacctcggccgggccagtcagagcgttggtagtagcttacacgtggtaccagcagaagccaggtcagtctaccaaagcctcctcatactaagtactcgtccttaccctacgttccctttctccgtaccgggggttcccctcggtacgggttcagggtcggacgtaggtggatcgtcggggactactacgtttacccacccctcacccatacaatacgccgtaggaacgacgtagaagtatgctgacttaactttacttacgtgtactattcaagtacgttaaccttaccttacctagtaacgtgtaccttacctacccggttaccggaaccggtaaccgggaaccgtaaccgtacgtacgggtaacgtaacgttaaacccgg

SEQ ID NO: 172479 - DNA, 629 bp, Homo sapiens
  misc_feature: GYAE6OF02HJGHM.27.78.H01.1.454.CMB.1.raw
  modified_base (300)..(300): a, c, t, g, unknown or other
  misc_feature (300)..(300): n is a, c, g, or t
tcagagcgtcgtctcacgaccggtgctcgatttagtgtgagtagtttgggtttggggatgagcaaaactaacaagtcaaggcaggaagatgttgccatcacaactcattgggtttctgctgctctgggttccagcctccaggggtgaaattgtgctgactcagtctccagtactttcagtctgtgactccaaaggagaaagtcaccatccacctggccgggccagtcagagtcggttggtagtagcttacactggtaccagcagagccaggtcagtctaccaaagctcctcatacagtancgtcttcccagttcccttcgtcgacggggtcccctcggaggttccaggtcgcgtaggtcggatcgagggaccagtactttaccacccgttacacccgtataccaacgttaccggtcgtacggtaagtccgtagaaacgtatacgtacgtcgtactaaactttacttactgttacacgtcgagtacgttaccttacctttactactaagttctaacctcgtaaccgttccggaacgaacgacgtaaccgacgtaggtaagtaacgttaaagtaccgttggtacggtacttacggactacccgtattaccgttgttacccttacgttaccc

SEQ ID NO: 172480 - DNA, 717 bp, Homo sapiens
  misc_feature: GYAE6OF02JVLPO.27.78.H01.1.454.CMB.1.raw
  modified_base (331)..(331): a, c, t, g, unknown or other
  misc_feature (331)..(331): n is a, c, g, or t
tcagagcgtcgtctcacgaccggtgctcgatttagtgtgagtagtttgggtttggggtagtgagcaaaactagacaagtcaaggcaggaagatgttgccatcacaactcattgggtttctgctgctctgggttccagcctccaggggtagaattgtgctgactcagtctccagtacctttcagtctgtcgactaccaaaggagaaacgtcaccatccaccgtcgccggccagtcagagcgttggagtagtcttacacgtacggtaccagacgaacgaacggtaccgaggtacacggttacctaaccaaacgtcctcctacagtccaaagtntcgaccttaccgtctaccgttccgcggtaccgggtcccctggtaggtcctaggtcggtcaacgtgggactcgacgggactacttacgttccgaacccactaccactacgtaaacgtccgtaccgtagggaacgtctaaggaaacgtagtccggacgtttacgaccttaaacttacgttactacgtacctacgtacgtaacgttacgtaaccttttaaccttaacccgttacgtaaactaccgttaacgtccccgttaacgggttacccgaaccggaaacgggttacgacccgtaagggtacgttaaaccgttaaaggttaaacccgtaggtaagttccgaacggttcaacccgacgttaccgtacgtttcggttaaccctttacgg

SEQ ID NO: 172481 - DNA, 512 bp, Homo sapiens
  misc_feature: GYAE6OF02FIZ0Z.27.78.H01.1.454.CMB.1.raw
  modified_base (179)..(179): a, c, t, g, unknown or other
  misc_feature (179)..(179): n is a, c, g, or t
  modified_base (416)..(416): a, c, t, g, unknown or other
  misc_feature (416)..(416): n is a, c, g, or t
  modified_base (466)..(466): a, c, t, g, unknown or other
  misc_feature (466)..(466): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcacctgccggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcatcctcaccatcaatacgcctggaanctagaagatgctgctaactttattactgtcatcagtatacttacttaccnctaagtgatcctaccttcggaccaagggaccagtactggaataacg

SEQ ID NO: 172482 - DNA, 621 bp, Homo sapiens
  misc_feature: GYAE6OF02GH6EF.27.78.H01.1.454.CMB.1.raw
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccagggtgaaattgtgctgactcagtctccagactttcagtctgtgactaccaaaggagaaagtccaccatccacctgccggccagtcagagcgttggtagtagcttacactggtaccagcagaagccaggtcagtcctaccaaacgcctcctcatcaagtatcgtccttcccacgttccttctccgtacgggtccctcggacggttcagtggacaggtggacgtcgcgggtacactactttccaccctcacctactactaacgtacgtccgtacggaactcgtagaagtntacgtcctcgactaacttacgttactcgtacttacgtactaacgtaacgttaaccttacctttactacgtaacgttacgtaacctaccgttaacccgttacggacccgtaaacgggtacctaaccgggtaacgtacgggtaacgtaagttaaaacccgg

SEQ ID NO: 172483 - DNA, 667 bp, Homo sapiens
  misc_feature: GYAE6OF02JS3P1.27.78.H01.1.454.CMB.1.raw
  modified_base (157)..(157): a, c, t, g, unknown or other
  misc_feature (157)..(157): n is a, c, g, or t
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
  modified_base (442)..(442): a, c, t, g, unknown or other
  misc_feature (442)..(442): n is a, c, g, or t
  modified_base (565)..(565): a, c, t, g, unknown or other
  misc_feature (565)..(565): n is a, c, g, or t
tcagagcgtcgtctcacgaccggtgctcgatttagtgtgagtagtttgggtttggggtagtcttaaaagaggttctttcttctgggatgtggcgatgagcaaaactgacaaggtcaagggcaggaagatgttgcatcaacaactcagttgggtttcngtctgcttctggggttcccagccctccgaggggtagaaatttggacgtctgacctnagtctccagtactttcagttctgtcgacctacaaaggagaagtccactancaccgtgcccggcagtcagagcgttggtgtacgcttactaccgtgtacgtagacaacggacgccgagtcagtcctccgtaaacnctacctcatactaagtacttcggccttccctacgttccccgttcctaccgtaccggggtttaccccctacgggttacggttcgtacggttagggntacggtcggtacgtcgtaggtaccgtactacgtttaccctaccgtacaccaatactacgtaacgtccgtaggtaacgcttagacgtagtcgctagtaccaaacgtttcttaccgtatacgtanacggtactaacgttaacttaccttacgtattaaccgtgaccttacgttacccgtaggtaccctacgggaacaccggttaacgaggttacgtaaagtaaccgg

SEQ ID NO: 172484 - DNA, 704 bp, Homo sapiens
  misc_feature: GYAE6OF02FYGIP.27.78.H01.1.454.CMB.1.raw
  modified_base (178)..(178): a, c, t, g, unknown or other
  misc_feature (178)..(178): n is a, c, g, or t
  modified_base (257)..(257): a, c, t, g, unknown or other
  misc_feature (257)..(257): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtnaaattgtgctgactcagtctccagactttcagtctgtgactccaaaggagaaagtcaccatcacctgccggcagtcagngcggttggtagtagtcttacacgtggtaaccagcaaggacgccgtaggtacagtacctaccgaaagtcctccctacaactcaaaggttactcggtccttaccctacggtttccttccgtaccggtaccgggggttccccctacggtacgggtttcgaagggttcgggacgtaaggttcgggacttaccggtacgggtaacctacttaacgtttacccctacccctacaacccctataccgtaaacgtacgtaccgttagggtaaacgtaccgtaagaaacggtagtacgtacgtacgtaaccttaagtttaacttacgttctacgtacttacgaacgtacgttaacccttaactttaccgtaccgtaagttcgaacttacccgtaacccggttccggaaccggtaacggtaccgaacgtaacggtacgggtacttaaagtaaaccgg

SEQ ID NO: 172485 - DNA, 622 bp, Homo sapiens
  misc_feature: GYAE6OF02GANX8.27.78.H01.1.454.CMB.1.raw
  modified_base (249)..(249): a, c, t, g, unknown or other
  misc_feature (249)..(249): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggttttctgctgctctgggttccagcctccaggggtgaaattgtgctgactcagtctccagtactttcagtctgtgactccaaaggagaagtcaccatcacctgccggccagtcagagcgttggtagtagcttacncgttggtaccagcagagccgaggtcagtctaccaaagctcctcatcaagtatgccttccagtccttctcacgggtcccctcgacggttcagtcggctagtgatcgtgggacacgtattcacccttcacctatcaagtacgcctaggaacgcgtagaaacgtagtcgcgttagacctaaactttacttacgttcgtactagtacgtacgtaacgttaaccttaccttttaacccgtactaacggttagtacttaccgttaacccgttccggaaccgtaacgggaactacggtaacgtacgggaacgtaaacgtttaaaccggaacttacggtacggtaccgttacgacctaccgtaactccgttacgtttaccc

SEQ ID NO: 172486 - DNA, 728 bp, Homo sapiens
  misc_feature: GYAE6OF02JO1A0.27.78.H01.1.454.CMB.1.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (344)..(344): a, c, t, g, unknown or other
  misc_feature (344)..(344): n is a, c, g, or t
  modified_base (563)..(563): a, c, t, g, unknown or other
  misc_feature (563)..(563): n is a, c, g, or t
tcagagcgtcgtctcacgaccggtgctcgatttagtgtgagtagtttgggtttggggagtcttaaaagaaggttctttcttctgggatgtggcatgagcaaaactgacaagtcaaggcaggaagatgttgccatcacaactcattgggtttctgctgctctggggttccagcctccgagggggtgaaatttggtgctgactcagtctccagtactttcagtctgtgactccgaaaaggnaaagtcaccatcncctggccggcatcgagagtcgttggtagagcttacactcgggtaaccaggacacgaaggcctaggtcacgtcctaccgaaagtcctccctanacttacgaagttactcgcctttaccccaacgtttccttaccgtcggtaacccgggggtccccctttagggaacggtttctaacgggtccgggacgtaaagggttcggactttaccgggtacggggtaacctaaccgttaaccggtttaccccacccgttacccgaaacctactaacgtaaactaccggtaccgttagggaaacgtacgtaggaaacgtntcggtactacgtaaccgtaatttacttacgtcgtaactcgtaaccgaacgttaagttaccctttaaccgtttacctacgaagttccttaatccccgtaaccgtttcccggggaactaacgggtaaccgaacgtaacgggtacggtaacgttaaaggttaaacccg

SEQ ID NO: 172487 - DNA, 624 bp, Homo sapiens
  misc_feature: GYAE6OF02GN94V.27.78.H01.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaagganaaagtcaccatcacctgccgggccagtcagagcgttggtagtagtcttacactggtaccagcgagaagccaggtcagtctaccaaagcctcctcatcaaagtntcgccttcccagttccttctcgtaccggggttcccctcggtacggttcaggtggccgtaggtcggatcgtgggaacactactttccaccctacacctactacaatacgaccgtaggaacgtctaggaagtagtcgtcgtacgaactaaactttattaccgttagtactatcgtaagtacttaaccttacctttaacctacgtaagtacgtactccgtaaccgttaccggaccgaaacgggactacggacgtagggtaacgtaacttaaacggaacgtaggtcggtacgtacgcctaaccgttacgtacgttccgttacttacccg

SEQ ID NO: 172488 - DNA, 711 bp, Homo sapiens
  misc_feature: GYAE6OF02I4HZI.27.78.H01.1.454.CMB.1.raw
  modified_base (255)..(255): a, c, t, g, unknown or other
  misc_feature (255)..(255): n is a, c, g, or t
  modified_base (683)..(683): a, c, t, g, unknown or other
  misc_feature (683)..(683): n is a, c, g, or t
  modified_base (697)..(697): a, c, t, g, unknown or other
  misc_feature (697)..(697): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtagaaattgtgcctgactcagtctccagtactttcagtctgtcgactaccaaaggagtaaacgtcaccatccaccgtgcccgggccagtcagagtcgttggagtagctacncgtcggtaccagcagaagccaggtcagtcctaccaaagtcctcctccatactaagttatcgtccttcccacggttcccttcgtaccgtacgggttccccctacggtcggttacgaggttacggcgtacggtaggacgttccgtacgggacctaccgttacgttttacccaaccccgttccaaccctaacgttacctaaaagttaccgtcggttaacggaaccgtacgttagaaacggtatcggtacgttaggaaccctttaaacgtttactttaaccgttacggtacctaacgttacgtaacgtaccgtttaaaccttttaaccttacccgttagtaacgtacgttaactaccgttaacccggttaccggaaccccggtaagggaccctaacgacgtaggtaacgtaaacgtaaacgacgttgaacgngttacaccgtaccnttctcgttcttacc

SEQ ID NO: 172489 - DNA, 624 bp, Homo sapiens
  misc_feature: GYAE6OF02F3QM2.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgcccgggccagtcagagcgttggtagtagcttacactcggtaccagcagaagccaggtcagtctaccaaagctcctcatacaaggtactcgtccttcccagttcccttcgtccgtacgggggtccccctacggtaggttccaggtcggcgagtggtatcgtgggactactactttcaccctcaaccatacaatcgcctaggaacgcgtagaagatgactcgactaaacgtttataccgttgtacatacgtaagtacgttaacttacctttaaccgactaagttacgtaacttacctaccgttacggaaccgtaagggaacctaacggacgtagggaacgtaaacggtaaaacgttaacgtggttacggtacgtacggtacctaaccgtcgttacgtttcgttaccgtttacc

SEQ ID NO: 172490 - DNA, 875 bp, Homo sapiens
  misc_feature: GYAE6OF02FIYCG.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtcaaccatccacctggccgggccagtcagagcgttggtagtagcttacactggtaccagcagaagccaggtcagtcctaccgaaagcctcctacactcgaagtatcgtccttccctacgtcctttcgtaccgaccggggttcccctacggtacgggtttccgaaggttcggaccgtaggtcggtacttacggtacggggtaacctaccgttacgttttacccgaacccccttaccgtaaaccctaccgttaaccgtaaaacgtaaccggtacccgttacggggaaacgttacccgtaggtaaacggttacgtacgttccgtaacggtacccttaaaaccgttttactttaccggttacgttaccgttacgttaaccgtaaccggttaaacggtttttaacccctttaaaccccgtttttaaccgtaaccggttaaacggttttaacggttaaccgtttaccccgttaaaccccggtttacccggggaaaaccccggtaaaccggggttaccccggtaaacccggttacgggttaacgggtaaaccgggtttaaaacccgtttaaaaacccgggtaaaccggtttaccgggttaccgggtaacccgttacggttaaccccggttaaaccccgttaaccggttacccggttttacgttacccgtttaaaccccg

SEQ ID NO: 172491 - DNA, 694 bp, Homo sapiens
  misc_feature: GYAE6OF02IZ1XY.27.78.H01.1.454.CMB.1.raw
  modified_base (472)..(472): a, c, t, g, unknown or other
  misc_feature (472)..(472): n is a, c, g, or t
tcagagcgtcgtctcacgaccggtgctcgatttagtgtgagtagtttgggtttgggggtagtgagcaaaactgacaagtcaaggcaggaagatgttcgccgatcacaactcattgggtttctgctgctcgtgggttccgagtcctccgtaggggtgaaagttgtggctggacctacaggtctccaggtcctttcagtctggtgactaccaaagggagaatcgacctatacaaccgtcggccgggccaggtcaggtacgtccgttggagtagccttacgacgtggtaccagcaagaacgtccgacggttcgaacgtcgtaccaaaggtctccctacgtatacccgaaagtatacggtccttcccgaaggtttccgttccgtacggaaccggggttccccctacgtacgggttttaccaaggttcggactaacggtggtacttcggacgggaactactaactttccacccctanaaccaactcgtaaatcgtaccgtaggaaacgtctaagacggtatcgactagacctaattaacgttcaggttacaacgttcaaacgtacggttaaccttactttaccctagacgtagtactcccgttacttcggacgaacgggactacggacttagggtagtaaaccttaaacgtacgtagttacggcgtaatcccgtaacctctttaggtaccttcctttag

SEQ ID NO: 172492 - DNA, 751 bp, Homo sapiens
  misc_feature: GYAE6OF02IAYKK.27.78.H01.1.454.CMB.1.raw
  modified_base (152)..(152): a, c, t, g, unknown or other
  misc_feature (152)..(152): n is a, c, g, or t
  modified_base (487)..(487): a, c, t, g, unknown or other
  misc_feature (487)..(487): n is a, c, g, or t
  modified_base (712)..(712): a, c, t, g, unknown or other
  misc_feature (712)..(712): n is a, c, g, or t
  modified_base (737)..(737): a, c, t, g, unknown or other
  misc_feature (737)..(737): n is a, c, g, or t
tcagagcgtcgtctcacgaccggtgctcgatttagtgtgagtagtttggggttgggggcatgagcaaaactgacaagtcaaggcaggaagatgttgccatcacaactcatttgggttctgctcgctcgtgggttccagccctccgaggggtnaaacttgtgctgactcagtcctaccagtacctttcagtctgtcgactacgaaaggagaaacgtcacactcaccgtggccgggacctaggtccaaggtacgtcggtttaggtaagttcgtaccttaccgagttaccggtaccaggaccaaggaacgcgacgggtcctaggtcctaaccaaacgtcctaccctactacgacctaaagttgtccgtaaccctcccttacggttcctttaccgtacgggtacccggggttccccttcgggtaacggttcgacgggtacgccgtaggtcggacgttacggcggtaactaacttcctttacccgacccctntaaccgtataacgtaagtccgtaaccgtaggaacctaggtagaatcggtcacgttactacctaacgtttaacaacttccggtaatactaaccgtacgttaacgttaactttacccggttaactaccggtaacgtacgtaccttacccggttaaccggtaccggaaacggaccgaactaccggttaacgacgggtaaacttaaaccggttacggaaggtttaccgnggtacctccggttaaccaccggttntttccgtacgttcc

SEQ ID NO: 172493 - DNA, 646 bp, Homo sapiens
  misc_feature: GYAE6OF02HYUIJ.27.78.H01.1.454.CMB.1.raw
  modified_base (149)..(149): a, c, t, g, unknown or other
  misc_feature (149)..(149): n is a, c, g, or t
  modified_base (463)..(463): a, c, t, g, unknown or other
  misc_feature (463)..(463): n is a, c, g, or t
  modified_base (630)..(630): a, c, t, g, unknown or other
  misc_feature (630)..(630): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggttctgctgctctgggttccagcctccgaggggtnaattgtgctgactcagtctccagtactttcagtctgtgactacaaaggagaagtcactatcaccgtggccggccagtcagagtcgttaggtagtagacttacgactaggtaccagacaagaacgccgtagtcagtctaccaagctacctacatactaagtactcgtccttacccgtacgttccttacgtccggtaccggtttccccgttaggtacggtttacgacggttggacctaggtacggtagtcgtacggactactactttaccgaccctacacgtataacacgtacgaccgaggtaactcgtagaagtntcgactcgtactaacttagttaccgtagtactagtactagtaacgttcttaaaccttcttaacgtagttactcgttaaccgttaccgtacggaaccgttaggacctacgtacggtacggtaaagtaacgtaacgtacgttacgtacggacttacggaccttaaccgnttacgttccgttaacg

SEQ ID NO: 172494 - DNA, 543 bp, Homo sapiens
  misc_feature: GYAE6OF02GW5OG.27.78.H01.1.454.CMB.1.raw
  modified_base (286)..(286): a, c, t, g, unknown or other
  misc_feature (286)..(286): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgcccgggccagtcagagcgttggtagtagcttacactggtaccagcagaagccaggtcagtctccaaagctccncatcaagtatgcttcccagtccttctcgagggtcccctcgaggttcagtggcagtggatcgtgggacacatttcaccctcaccatcaatacgcctggaagctagaagntgctgaccaacttattactgtcatcagtagtacttacttacctanaagtgacttcaccttccggaccgaagggaccacgtacgtggaagtaacgttaaaccggacgtggtacggtcgtcggaccaacctagtccttacgttccttaccg

SEQ ID NO: 172495 - DNA, 878 bp, Homo sapiens
  misc_feature: GYAE6OF02F3VFQ.27.78.H01.1.454.CMB.1.raw
  modified_base (669)..(669): a, c, t, g, unknown or other
  misc_feature (669)..(669): n is a, c, g, or t
tcagagcgtcgtctcacgaccggtgctcgatttagtgtgagtagtttgggtttggggggcagtgagcaaaacctcgacgtaacgtcgaaggcaggaagatgttgccatcacaactcattgggtttctgctgctcgtgggttcctagcctccgaggggtgaaacgtttgtgctgtacttcgtacgtcctccaggtacctttcgtacgttccgtggtcgtaccgttaccggaaaagggaacggtaaaggtacctacctacgtcctaccgtccgggcccgggggccctacggtaccacggtacgtccggtttagggtacgtaacggtacctttaccgtacgttcgggtaacccacggaccgtaacggaaacgtcccgtaacggtaccgtaacggttcctaacccgaaacgtcccgttacccgtactacgtaccgtaaacgttcggtacggtacccttacccgtacggttacctttcgtaccggttacccggttccccgtacggtacggttcgacggtcgacgtacggtcggacgttacggtacggactacgtacgtttacccaccctacgaaccgtacgtaccgtaacgttaccgtaccgttaggaaccgtacggtaagtaacggacgttacgtacgttaacggaaccttaaaccgttttacgttaccggtnttaccgtaacttaaccggtaacgggttaaccgtttaccctttaaaccgtttaccgtaacggttaaggtacttaaccgtacgttaacccggttacccggaacgttaaccgggtacctacggtacgtaacggtaacgtaacgttaaacgggtaacgtcggtaaccgtacgaccgttacccggtaacgtacggtttcccggttctaacccgg

SEQ ID NO: 172496 - DNA, 681 bp, Homo sapiens
  misc_feature: GYAE6OF02HEXBF.27.78.H01.1.454.CMB.1.raw
  modified_base (199)..(199): a, c, t, g, unknown or other
  misc_feature (199)..(199): n is a, c, g, or t
  modified_base (493)..(493): a, c, t, g, unknown or other
  misc_feature (493)..(493): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctgggttccagcctccgaggggtgaaattgtgctgactcagtctccagtactttcagtctgtcgactacgaaagganaaagtcaccatcacctgccggcagtcagagtcgttggtacgtagtcttacactcgggtaaccagactaggaacgccaggtcacgtcctaccgaaacgccttacctcaatacaaggttactcgtacctccctacgttccttacgaccggtaccggggtcccttaggtacgttcaggtcggactaggtacgactcgaggacctacgtacttaccgacctacaaccagtactaaacgtcgacgtaagaacgtcgtaagaacgtagtacggctaacgacctaaacgtttataccggtntacctaaattacgaacggttaacttaaccgttcctttaaacgaccgtagtacgtactaccgttaaccgtacgggtaacgaaagggtaaccacggtacggttaaggtacgtaaaacggttaaccggtaagttccgggtacggtacctccgggtaaacctccttaacgttcgtttacggtaccttaccgg

SEQ ID NO: 172497 - DNA, 573 bp, Homo sapiens
  misc_feature: GYAE6OF02IUXCJ.27.78.H01.1.454.CMB.1.raw
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (547)..(547): a, c, t, g, unknown or other
  misc_feature (547)..(547): n is a, c, g, or t
  modified_base (568)..(568): a, c, t, g, unknown or other
  misc_feature (568)..(568): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaaccatccacctgccgggccagtcagagcgttaggtagtagcttacactggtaccagacagaagccaggtcagtcctaccaaagctcctcatactaagtatcgcttccctacgtccttctcgacgggtcccctgtacggttcagtggcagtgatcgnggacacgtatttccaccctcaactatacaatcgctaggactactagaatagtnactcgtaactaactttaacttacgttacgtactaagtacaagtacgttaaccttactttaaccgtactaaagtgtaactactaccgttacgacgaaacggacacgactaggaagtaataaaccgacgtagtacgtntacgaccactactcgttactnttacc

SEQ ID NO: 172498 - DNA, 808 bp, Homo sapiens
  misc_feature: GYAE6OF02JTM89.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaagtcaccatccaccgtcggccggccagtcagagtcggttaggtagtagtccttacgacgtcgggtaaccagacagaacgccgaggtaccacgtctaccgaaagcctaccgtcactacaagtactcgtccttcccacgttccttaccgtccggtaccggggttccccctacggtaccggtttccgaggttcgggacgtacggtagggtacttcgggtacgggacctaacttacgtttcccaaccccgtacctaacccgtacttaaccgtaaacgttaccggtacccgtaacgggtaacgtacgttaacggaaacggtaacgtcggtaaccgtacgtaaccgttaaacctttaactttaccgttaccgttacttaacgtaaccgttaaggtaaccgtttaaaccgttttaacccgttttaaacccgtacggttaaaccgttacggtaaccctttaccccggttacccgttaaaccgggacccggtaaaacgggtaccgtaaccgtaccggttaagtaaaccggtaaacgttaaaccggttaccggtaaggttaccggtaccgtacggtaccgtaacccgtcgtttaccgttacgttccccgtttaaccg

SEQ ID NO: 172499 - DNA, 648 bp, Homo sapiens
  misc_feature: GYAE6OF02FGLCE.27.78.H01.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagccttccaggggtgaaattgtgctgactcagtctccagactttcagtctgtgactccaaagganaagtcaccatcacctgccgggcagtcagagcgttggtagtagcttacactggtaccagcagagccaggtcagtctaccaaagcctcctanactcaagtatcgccttcccagtccttcgtcgtaccggggtcccctggacggttcagtggctagtggatcgtgggtacacttactttccaccctactaaccctagttaccaaagtacgcccgtaaggtacgtactaggaagtattcgcgtacgtactaacctttagtttactacgtacctacttacgaagtacgtttaacctttaacctttacctacgtaagttcgtaaccgttaccgttaaccggttaccggaacccggtaagggaaccctaccgtacgtacggaacgttaaacgttaaaccggcttacgggtcgtacgtaccggtacctaacccgtatttccgtacgtttcccttaccg

SEQ ID NO: 172500 - DNA, 643 bp, Homo sapiens
  misc_feature: GYAE6OF02GBTKY.27.78.H01.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggnaaagtcaccatcacctgcccgggcagtcagagcgttgggagtagcttacactggtaccagcagaagccaggtcagtctccaaagctcctcatcaagtatgtccttccagtccttctcgtacggggtccctcggtaggttccagttcggctaggtgactcgtgggactacagtttccacccgttcaccctataccaaagtacgccgtaggaaacgtcctagaaacggtacttcgacttggaccttaaccttaatttaaccgttacggttacaacgttacgtaacgtaacggtttaacctttaaccttttacccgtactaaggtctacttacccgtaccctttacgggacccgaaacgggacctacggtaccgtagggaacgttaacttaaaccgtacgttaggtccgtaaccgtcgaacctacccgaatttcggttccgttcttacccg

SEQ ID NO: 172501 - DNA, 636 bp, Homo sapiens
  misc_feature: GYAE6OF02JLJV8.27.78.H01.1.454.CMB.1.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (456)..(456): a, c, t, g, unknown or other
  misc_feature (456)..(456): n is a, c, g, or t
tcagagcgtcgtctcacgaccggtgctcgatttagtgtgagtagtttgggtttggggggcgatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaatcaccntccaccgtgccgggcagtcagacgcgttggtagtagtccttacacgttcggtacctagacagaacgccgaggtcaacgtctaccgaaagcgtccctcatacaagtatcncttccacgtccttctcgcgggtccccgtgacggttcagtggcaggtcggattcgnggctacgtatttccacctaccacactacatacgctaggaactcgtaagacgatgtctcgaactaacttacttacgtacgtanactcgaattaccgttactttaaccgtttacctacgtaagttcgtaaccttccgttaacctccgggtaaaccgtaccgggtaacgtaccgtaaccggtacgggtaagttaaaccgttaaaaggtacttacgggtaccggttactacccgggtatacccgaactttccgtttcgttaacccg

SEQ ID NO: 172502 - DNA, 735 bp, Homo sapiens
  misc_feature: GYAE6OF02GCAUS.27.78.H01.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
tcagagcgtcgtctcacgaccggtgctcgatttagtgtgagtagtttgggtttgggggggcgatgagcaaaactgacaagtcaaggcaggaagatcgttgccatcacaactcattgggtttctgctgctctgggttccagcctcaggggtnaattgtgctgactcgagtcctccagtactttcagtctgtgactcaaaggganaagtcaccatcacctggccggcagtcagacgcgttggatagcttaanacgttggtaccagacagtaagccaaggtcagtctaccaaagcctacctacactacaaacgtatcgtaccttcccaggttcctttactaccgacgggggttcccccttacggtacggtttactaggtcggactacggtggactcgtagggactacgtacttttaccgacccttacaaccgtaattaccaaacgttacgtcccgttaacgggaaacgtaccgttaaggaaacgtaacgttacggaccttaggtaacctaaacgtttaacttaacgttacgtactaacgttacaaaccgtacgttaacttacctttaaccgttacgaacttacggtaacttaccgtaacccgtttaccgggaacccgtaacggggaaccgtaccgggaagttacggggtaaacgtaaacgtttaaaaccggttaaaccgttagggttaaccggtacgttacgaaccggttaacctaacggtttacttacggtttaccc

SEQ ID NO: 172503 - DNA, 535 bp, Homo sapiens
  misc_feature: GYAE6OF02FI8SO.27.78.H01.1.454.CMB.1.raw
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccgggccagtcagagcgttggtagtagcttacactggtaccagcagaagccaggtcagtctccaaagctcctcatcaagtatgcttcccagtccttctcacgggtcccctcgaggttcagtggcagtgatcngggacaattcacctcacatcatacgctagaanctgaagntgctgactatacttantacatacgagtacgtaacttacctttacctactaacgtntaactcctacccgttacggacctaacgggacctacggacgtaggacgtaagttaaccgtaacgg

SEQ ID NO: 172504 - DNA, 701 bp, Homo sapiens
  misc_feature: GYAE6OF02I5S0O.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagccctccgaggggtgaaattggtgctgactcagtcctccagactttcagtctgtgactaccaaaaggagaaagttcaccatccacctggcccgggcagtcagagtcggttggtatagccttacacgtcggtaccagacaggaacgccgaggtcagtctaccaaagcctctcatacaagtatcgtccttacccgtagttcccttcgtaccggtcccggggttcccctaggtacgggttcgtaggtcggcgtaggtggtcgttcggtacgggaactacgtactttacccacccttcccaaccagttaaccaaagttaccgaccgttaagggactaccgtaaggaacgtactcggtacgtacgtacttaaacgtttacttactttacgtacgtatacggtaacgttaaccgtttaccctttaaaccttttacccgtaccgtaagttcttaactacccgttacccgtacggaccggtaaacggaccgtaccgtaaggtcggttaaacggaagtttaaacccgaaggttacggacggttcacgccgtaacctacgttctcgtttaaccc

SEQ ID NO: 172505 - DNA, 762 bp, Homo sapiens
  misc_feature: GYAE6OF02IAJCE.27.78.H01.1.454.CMB.1.raw
  modified_base (336)..(336): a, c, t, g, unknown or other
  misc_feature (336)..(336): n is a, c, g, or t
  modified_base (413)..(413): a, c, t, g, unknown or other
  misc_feature (413)..(413): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccgaggggtgaaattgtgctagactcagtctccagactttcagtctgtgactaccaaaaggagaaagtcaaccatcacctggccggccaagtcagagtcgttaggtagtagcttacactggtaccagacagaacgccgaggtcagtacctaccaaacgccttcctanaactacaaagttatacgccttaccccacgttccctttacgttaccggaccgggttcccctaacggtacggttaccgngggtcgacgtaggtcgggagtttaccggtaggggtaacctaacgttaccgttttacccctaaccccgtaccgtaaaccctaattaaccgtaaacttacggaccgttaaggaaacgttaccgtaggaaacgtagtacggacttacggtaaccttaaaccgtttacttaaccgttggttaacctaacgttaacgtaacgttaaacgtttaacccgtttaaccttttacccgtaaacggtttaacgtacgttaaccgttacccgttaaccccggtttaccgggaacccggtaaaacggggtacccgtaaaccggttaacggtttacggtaaaggttaaccgttaaaaccggg

SEQ ID NO: 172506 - DNA, 673 bp, Homo sapiens
  misc_feature: GYAE6OF02JDX8P.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcatcatcacctgccgggccagtcagagtcgttggtagtagcttacacgtggtaccagcagaacgccgaggtcagtctaccaaagcctcctcatcaagtatgccttccagtccttctcgacggggtcccctggtacgttcgaggtcggactaggtggactcggtacgggactacttacgtttacccaccctaccacctataccaacgtaccgtaccgtagggaacgtaccgtaaggaaagtagtcgtacgtacgtaccttaaactttacgtttacctacggttacctaactacgaacggttaaccttaacctttaaccttttacccgtacgttaacgttacgttaaccttcccgtaaccgttacccgggaaccgtaaacgggtacccgaacgtaccggtaacgggaacgttaaacgttaaaaccggacgttaggtacggtctacggaccctaaccgtacttacgttaccg

SEQ ID NO: 172507 - DNA, 588 bp, Homo sapiens
  misc_feature: GYAE6OF02HG7MW.27.78.H01.1.454.CMB.1.raw
  modified_base (217)..(217): a, c, t, g, unknown or other
  misc_feature (217)..(217): n is a, c, g, or t
  modified_base (451)..(451): a, c, t, g, unknown or other
  misc_feature (451)..(451): n is a, c, g, or t
  modified_base (530)..(530): a, c, t, g, unknown or other
  misc_feature (530)..(530): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtnactaccaaggagaaagtcaccatccacctgccggccagtcagagcggttggtagtagtcttaccactggtaccagtacagaagccgaggtcacgttactacccaaagcctcctcactactaagtatcgtccttccacttcctcgtccgtacgggtcccctcgtacggttcgaggttggactaggtcggtacgtcggtacgggacacttacttaccaccctcgaccatacatacncgtaggacactgaacgatcgactgacttaactttactacttgtacactcagtaacgttactacctttacgtacgtagtntacctacgaccgttaccgacgaacggtacccaaggtacggtaggaacgtaactaacgg

SEQ ID NO: 172508 - DNA, 761 bp, Homo sapiens
  misc_feature: GYAE6OF02H7QT9.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactcgaaaggagaagtcacatcacctgccgggccagtcagagtcgttaggtagtagtacttacacgttacggtaccagacaaggaacgccgtaggtcaacgtcctaccaaacgccttaccctacactacgtaagttagtacgtccttacccgtacgttccctttccgtaccgtaccggggtacccccgttggtaccggttcgaggtcggtacgaggttgtacgtcgtacgggaactaacgttactttcccctacccgtccaacccgtaactacgtaacgtacgacccgttaagggaacgtaccgtaggaaacgtacgtacgccgttaagtacctttaaaactttaccggtttaacttcgttaccgtaacttcgaaacgttaaacgtttacccgtttaaaccttttaaccgtacgttaaagggttacctaaccgttacccgttacccgggtttaaccggaacccggtaaacgggcctaaccgtaacgggttaggaaacggttaaaccgttaaaacgaccggtttaacggttcggaccgttacgaacctacccgttaactttcgtcgtttaaccc

SEQ ID NO: 172509 - DNA, 689 bp, Homo sapiens
  misc_feature: GYAE6OF02JKFHB.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtagaattgtgctgactcagtctcagtactttcagtctgtcgactaccgaaaggagaaacgtccaccatcacctcgaccggccagtcagagtcgttaggtagtagcttacgacgtcggtaaccagacgaagaacgaccgtacggtactacgtacctaccaaacgtcctaccgtacactataacgtactcgtcctaccacgttccttacgtcgtccggtcccgtcgtaacggttcgacggtcgactaggtcggtacgtcggtacgggaacctacgttactttccccgacccgttaaccaccttaactacgtaacgtacgtaccgtaaggaacgtacgtacggaaacgtctagtaccgttagacctttaaacgtttacttacgttacgtacctagttactaacgttaaaccttaccgtttacctttaccgtacgttaaggtacgtacttaccggtaccgttaccgggaacgtaacggaacctaccggaagtaacggtaacggtaagttaaaccgg

SEQ ID NO: 172510 - DNA, 689 bp, Homo sapiens
  misc_feature: GYAE6OF02HP967.27.78.H01.1.454.CMB.1.raw
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggnaaagtcaccatcacctgccgggcagtcagagcgttgggagtaggtcttaacgacttggtaccctagcaaggtaacgccgaaggttccaggtacctacccgaaaacgccttcctacactacaacggttaatcggccttacccacgttcccctttcctccgtacggggttccccctcggacggtttaccgaacggtcggacgtaggttgggaccttcggtaggggacctacgttactttccgaaccctccaccgacttacaacgtacgtaccgtaggaaccgtcgtacggaaatacgtagactacgtactaaacctttgtaacttcgtactactacgagtaacgttacctttaacttaacctacgtaacgtgtacttacctaaccgttccggaaccgaacgggtaacacccggtagacgggtaacggtaaacgtaaaccggttaactagggtacgtactacgacccgaaccgttactacgttcgttaccttaccg

SEQ ID NO: 172511 - DNA, 612 bp, Homo sapiens
  misc_feature: GYAE6OF02HZLK7.27.78.H01.1.454.CMB.1.raw
  modified_base (290)..(290): a, c, t, g, unknown or other
  misc_feature (290)..(290): n is a, c, g, or t
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
  modified_base (585)..(585): a, c, t, g, unknown or other
  misc_feature (585)..(585): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctggtcccagcctccaggggtgaaattgtgctgactcagtctccagtactttcagtctgtgactaccaaaggagaaagtcaccatcacctgccgggccagtcagagcgttggtagtagtcttacactggtaccagcaagaagccgagtcagtctacaaagctcncatacaagtatcacttcccgagttccctttactcgtaccggggtcccctcggtacggttcaggtcggtcgacggtggtaacgtcgtcgggtaacaccgtaatttcccaaccctccaacctaactacaacgtacgtccttaagggactacgtagaaacgtntcggtacctagaccgttaaactttacttacgtntcgtaactcgagtaaccgttactttaccttactacaagtcgtaatcctaaccgtcggacctaagggacctagtacggtaggaataacttaaacgaagttcgngtacgtcgacaccgttatcttagtacc

SEQ ID NO: 172512 - DNA, 740 bp, Homo sapiens
  misc_feature: GYAE6OF02F7JXO.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaagtcaccatcacctgccgggaccagtcagagtcggttggtagtagtcttacacgtcggtaccagacgagaagccgaggtcacgtctaccgaaagctcctcatactaagtatgtaccttcccgacgttcctttacctccggtaccggggttccccctcgggtacggttcgtacggtcgggcgtaacggttggtacgttacggtcgggaactaccgttaccgtttacccgaaccccttaccgtaaaccctaacgttacctaaacgtaccgtaccgttagggaacgtaccgtagggaaactagttcgtaccgtcgtaaccttaaaccgtttactttaacgttacgtactactacgtaacgttaacgtttaacctttaacctttaccgtaacgttaacgtacgttaacttacccgttaacccggtcccggtaaccggtaaaccgggaccgtaaccgttacggtacggtaacgttaaacgttaaaccggtaacgttacggttcggtacgtacggtactaaccgttactacgttcgttacttacccg

SEQ ID NO: 172513 - DNA, 713 bp, Homo sapiens
  misc_feature: GYAE6OF02GUF6V.27.78.H01.1.454.CMB.1.raw
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttccagcctccgaggggtagaaattgtgctgactcagtctccagtactttcagtctgtgactaccgaaaggagaaacgtcaccagtccaccgtggcccgggaccagtacagaggtcgttggtagtacgcttaacacgttcggtaaccagcgaagaacgcgaaggtcacgtctaccgaaagtcctcctacacgtacaagtactgccttaccgacttccttctccggacgggttcccctgtacgttcgaggtcgcgtagtacgggatcggnggtaccacttactttaccgcccttacaaccngtacaagtacgtccgtagggaactcgtagaacgtagttcgaccgtacgtacttaaaccgtttattacgttgttaccaacgttacgaagttaacgtttaccgtttaaccctttccgtaactaacggttacgtaaccttccgttaacccgttccgggtaaacggaaacccgggtagtaaccggtaggtaacggtaaccgttaaaagggttaaacccgtacgggtttcggtaagggtttcccgaacgtcccgttaaccgttgtaaccggttccgttacctttacccg

SEQ ID NO: 172514 - DNA, 608 bp, Homo sapiens
  misc_feature: GYAE6OF02GKD7H.27.78.H01.1.454.CMB.1.raw
  modified_base (179)..(179): a, c, t, g, unknown or other
  misc_feature (179)..(179): n is a, c, g, or t
  modified_base (317)..(317): a, c, t, g, unknown or other
  misc_feature (317)..(317): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgacctaccaaaggagaaagtcaccatcacctgccggccagtcagagcgttggtagtagctacactggtaccagcaagagcaggtcagtctcaagctcctnatcaagtatcgccttacccagttcccttctcgacgggtcccctcggtacggttcaaggtggctaggtggacgttcgtgggtacctactactttaccgacccctaccaccataccaactacggaccgtaggaacgtcgtagagtagtgccgtagtactaaccgtttattaacttgtactacttactacgtaacgttaccttaacctttacctacgtaagtactaccttaccgtaccgttaccggaaccgaacggtaccgaaccggtacgtacggtaacgtacgttaaaacgg

SEQ ID NO: 172515 - DNA, 543 bp, Homo sapiens
  misc_feature: GYAE6OF02GLZRU.27.78.H01.1.454.CMB.1.raw
  modified_base (295)..(295): a, c, t, g, unknown or other
  misc_feature (295)..(295): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtancgtccttcccagtccttctcgacgggtcccctcgtacggttcagtggcaggtggatcgtggacatactttcaccctcaccatacaactacgcgtaggaacgtcgtagtaagatgctacgactaacttattactgtcctatacagtatacttacttactactaagtcgatcctaccgtcgacgaaggaccagacgtaggagtaacttaaacgatcgtagaccgtgacccgactacgtcttcgtcttacc

SEQ ID NO: 172516 - DNA, 601 bp, Homo sapiens
  misc_feature: GYAE6OF02I7UHI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacactggtaccagcagagccgaggtcacgtctaccaagtctacctcactacaagttactcgccttacccgagttcccttccgtcgtaccggggttcccctacggtacggttacacggtcggactaggtaggtatcgtggactactactttccaccctacacctatactaactacgccgtaggaagcgtagaagtactgtactagtactaacttattacttgtacatcaagtacgtacttacttactagtacgtatccttacgtaccttcggaccgtaaggacctacgacgttaggaacgtaacgttaaaccgagtacggtcgactacgaccgtaacctattaccgttgtaccttacc

SEQ ID NO: 172517 - DNA, 697 bp, Homo sapiens
  misc_feature: GYAE6OF02II5CB.27.78.H01.1.454.CMB.1.raw
  modified_base (178)..(178): a, c, t, g, unknown or other
  misc_feature (178)..(178): n is a, c, g, or t
  modified_base (348)..(348): a, c, t, g, unknown or other
  misc_feature (348)..(348): n is a, c, g, or t
tcagagcgtcgtctcacgaccggtgctcgatttagtgtgagtagtttgggtttgggggatcttaaaagaggttctttctctgggatgtggcatgagcaaaaactgacaagtcaaggcaggaagatgttgccatcacaactcattgggtttctgctgctctgggtccagcctcagggtnaaattgtgctgactcagtctccagactttcagtctgtgactccgaaaaggagaaaacgtcaaccaagtccaacctggcccgggacaagtcagagcgttaggtagtagtcttaacacgtggtaccagcaagaacgaccaggtcagtctaccaaaagtcctacctacactanaaagtactgtcctacccacgttccttcgtccgtaccggggtcccctcgtacggttcaggtggacgaggtggtactcgtagggacctacgttacttcccaaccctccaacctactactaaacgtacgtcctaagggaaacgtccgttaaggaaataacgtcgtacgttacgaaccgtaaacgttttaacgtttaacgttacgtacttaaaccttacgtaacgtaacgttaaccctttaaccgtttaccgtaacgtaacgtaacgtaacgtaccttaacccgttaaccggaaccggtaacgggaaccctaaccggtaacggtaacgggtaacggtaaacgttaaaaccggg

SEQ ID NO: 172518 - DNA, 531 bp, Homo sapiens
  misc_feature: GYAE6OF02F8QMV.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatcgtgggacactattcaccctcaccatcaatcgcctaggagctagagatgctgacaacttattactgtcatcagtagttacttactttaccactaagtntactctaccgttcggaccgtaagggacacgactgggaacgtaattaaacgaactgtaggctagacctaccattccgtgttaccg

SEQ ID NO: 172519 - DNA, 812 bp, Homo sapiens
  misc_feature: GYAE6OF02HCTFP.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgagggtgaaattgtgctgactcagtcctccagtacttcagtctgtgacctaccgaaaaggagaaacgtccaccataccacctggcccgggcagtcagagcgttggtagtagctacgactggtaccagcagaacgccaggtcacggtacctaccaaacggtccttccctacactaacaagttactcgtccttacccacgttcccttcgtccggtaccggggttcccccgttacgtacggttctaggttcgggacctagggtcggtacgtcggtaggggtacctaacgtttactttccccgaacccctccctaaccctaacgttacctaaacgttaacccggtccgtaaacgggtaacgtaccgtttaacggaaaccgaagttaccggtaccgttaccgtaacctttaaaaccgtttaacgtttttaacccgttaggttttaaccctaacgtttaaccgttaaacggttaaacccgtttaaccctttttaaaccccgtttttaaccccgttaacggttaacgttaaccggttaacctttaaccccgtaccgggttttaaccccgggacccggttaaaaccggggacccgtaaaccgggttaaccggtaaccggggtaaagttaaacccgttaaaaaccggg

SEQ ID NO: 172520 - DNA, 585 bp, Homo sapiens
  misc_feature: GYAE6OF02HW08R.27.78.H01.1.454.CMB.1.raw
  modified_base (266)..(266): a, c, t, g, unknown or other
  misc_feature (266)..(266): n is a, c, g, or t
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatcttaaaagaggttctttctctgggatgtggcatgtagcaaaactgacaagtcaaggcaggaagatgttgccatcacaactcattgggtttctgctgctctgggttccagcctccgaggggtgaaattgtgctgactcagtctccagtactttcagtctgtcgactaccaaaaggagaaagtcaaccatcacctgccgggcagtcagngcgttggtagtagcttacactggtacccagcagaagccaggtcagtcnccgaaagcctcctcatacaagtatcgcttcccagttcccttcgtcgtacggggtccccttcggtacggttcagtggcgaggtcgagtcgtaggacactatttccaccctcacctanactaaatacgcctaggaacgcgtagaagtatgactagaccttaaattactttaactgtacagttacacgtaataccttaacttacctactaacgtgactacctaccgttacgacgaacgggtaccacggtaacgtacggacgtaagttaaaccgg

SEQ ID NO: 172521 - DNA, 801 bp, Homo sapiens
  misc_feature: GYAE6OF02I3KXX.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaaattgtgctgactcagtctccagtactttcagtctgtgacctaccgaaaggagaaacgtccaaccactccaccgtcggcccgggaccagtacgagacggtcggttaggtacgtacgtacttaccacgtacggtaaccagaccaaggaacgtccgaggttcacgtcctaccaaacgtcctccttacataccgaaagttctcgtccttacccacgttccctttacctccggtaaccggggttccccctaggttacggttccgtacgggtcggacgtacggtggtaacttccggagggtaacctacgttactttcccgaacctcccgaacctactaccgtaaacgtccgtaccgtaacgggaacgtaccgtaaggtaacgtagttacggaccgtagtaaccttaacgtttaacttaccgttgtaccgtacgtacgttaacgtaaccggtttacctttaaaccgtttaccgtaccgttaaacggtcttaccgttaccggttaacccgtcccgggtaaacccggaaacgggtaacccgttaccggaacggttaaccgggtaaaggttaaacccggtaaaaccgttaaccgttcgggtaaccggttaccgttaccggtaaccccaaccggtttacttaccgttccgttttaccccg

SEQ ID NO: 172522 - DNA, 606 bp, Homo sapiens
  misc_feature: GYAE6OF02IEKNQ.27.78.H01.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaagganaaagtcaccatcacctcgccggccagtcagagcgttggagtagcttacacgtggtaccagcagaagccaggtcagtctaccaaagctcctcatcaagtatcgcttcccngttccttctcgacgggttcccctcgtacggttcagtcggcaggtgagtcgtaggactactactttccaccctcacctatacaatcgcctaggacgtcgtagaagatgtctagtactaacgttactttactcgtactagtactagtacgttaacctttaacctttacctacgtaagttcgtaacttacccgttaacccgttccggaaacggaacggtaaccgtaccgagtacggtacgtaaacgtttaaacgtccgtacgtcggtactacgacctaaaccgtctacgttcgtaccttaccg

SEQ ID NO: 172523 - DNA, 749 bp, Homo sapiens
  misc_feature: GYAE6OF02FPZAP.27.78.H01.1.454.CMB.1.raw
  modified_base (146)..(146): a, c, t, g, unknown or other
  misc_feature (146)..(146): n is a, c, g, or t
  modified_base (374)..(374): a, c, t, g, unknown or other
  misc_feature (374)..(374): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaccatcaccgtgaccgggccaggtcaggagtcggttggtagtagcttaacacttggtaaccagcaaggaacgccgagggtccaggtcctaccaaagctccctcatacagtatcgccttaccacgtccttctccggacgggttcccctaagtgttcgtacgtggcaggtacgntcggtacggactacgtacctttacacccccgttacacctacttacgaacgttacgaccgttaggaacgtccgttaagaacgtacgtacggtctacggtaccttaaccgtttatttaaccgttcgtaactacttaaccgtacggttaaactacctttaaccgtttaaccttacgtaaacgttttacggacctttacccggttaaccccgttccgggtaaaccggaaaccggggttaccgaacccggttaaccggtaaggtaaacgttaaaaccgggtttaaaacccggtaaccgtttaaggggttacccgggtattacccggtaaccctaaacccggttcccgtttaaccgggtttccctttacccggtttaaccc

SEQ ID NO: 172524 - DNA, 671 bp, Homo sapiens
  misc_feature: GYAE6OF02GA0F9.27.78.H01.1.454.CMB.1.raw
  modified_base (249)..(249): a, c, t, g, unknown or other
  misc_feature (249)..(249): n is a, c, g, or t
  modified_base (664)..(664): a, c, t, g, unknown or other
  misc_feature (664)..(664): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccgaaaggagaaaagtcaaccgatccacctgccgggcagtcagagcgttggtagtagcttanactcggacagcagaacgccaggtcaggtctaccaaagcctcctcaatacctaaagtatgtacccttcccgtaacgttcctttaccgtccgtaccgggggttccccgttacggtacggtttacgacggtcgggccgtaaggtacggaacgttcgtacggggactacgtaacttttaccgaaccccttacaaccctaataccgaaatacgtccgtacgggaaacgtctaggaaacgtacgtagtcgtacgtaccttaaacttaacttaccgtagttaccaactcgaaagtaacgtttacttaacctttacctaacgtaagtacgtactacctaccgttaccgaaccgaagggtacacgtagtacggtaagtaacttaaaccgacgtcgtaggactacgacgacctagtcgtttacgngttaccc

SEQ ID NO: 172525 - DNA, 642 bp, Homo sapiens
  misc_feature: GYAE6OF02GX28U.27.78.H01.1.454.CMB.1.raw
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
tcagagcgtcgtctcacgaccggtgctcgatttagtgtgagtagtttgggtttggggggcatgagcaaaactgacaagtcaaggcaggaagatgttgccatcacaactcattggtttctgctgctctgggttccagcctcaggggtgaaattgtgctgactcagtctccagtactttcagttctgtgactaccgaaaggagaaacgtccaccatccacctggccgggccagtcagagtcggttggtagtagtctacacgtcggtaccagcagaacgccgaggtacagtcctacaaacgtcctcctcaactcaagttatcgtccttcccacgttccttctcgccgggtccctggacgttcngtggcaggtgatcgnggacactattcccacctaccacctatactactacggtaccgtaggacgtntaaggaatcgtacgtcgtacgtaaccttaaacgttttacgttactacgttacctaactacgtaacgtaacgtttacctttaacgtttaaccctacgtaacgtacttaaccttaccttaccggttaccggaaaccgtaacgggaccgtacggtacggtaggtaaacgtaacgttaacgaacgtcggtcgactacgtacctactacgttcgttcgttac

SEQ ID NO: 172526 - DNA, 712 bp, Homo sapiens
  misc_feature: GYAE6OF02GCHFZ.27.78.H01.1.454.CMB.1.raw
  modified_base (145)..(145): a, c, t, g, unknown or other
  misc_feature (145)..(145): n is a, c, g, or t
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtnaaattgtgctgactcagtctccagtactttcagtctgtgacctcgaaaggnaaagtcaccatcactgccggcagtcaggagtcgttaggtagtagccttacngtcggtaccagcaagaacgccaggtcagtctccaaagctcctnatactaagtactcgccttccgagttccttcgacgtaccggggttcccctaggtacggttcgaaggtcgggtactggttacggacttcggtagggacctaaccgttacttttacccaacccctccaaccctatacctaaactcgacccgtaggaaacgtcgtaagaaacggtacttcggtactacgttaaccctaacgtttaacttaccgttagtacctaagttaccaaacgggtttaacctacttttaacccgtttaaccgtacgtagttacgtaaccttaccggttacccgttaaccgggaaccgtaaacggggtaaccaaccggttaggtacggtaaacgttaaacgttaaaaccgttacgggttacgacgggttactaccgtacccgtaccttaagtcccggtttactaccgtttaccc

SEQ ID NO: 172527 - DNA, 648 bp, Homo sapiens
  misc_feature: GYAE6OF02GPU2B.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgacctccgaaaggagaaagtcaccatccacctgccgggctagtcagagtcggttggtagtagtcttacactggtacagcagacgccaggtcacgtcctaccgaaagtcctcctcatacgtaagtatcgtcccttccctacgttccctttccgtccgtaccggggttcccccttcggtacggttacgagtcggacgtaggtgggtattcggtcgggtacctacgtactttacccgtaccctccaacctactacaacgttacgccgtaggaagtcgtaagaacgatcgtacgtacgtacttaactttattaccgtgttactacgtactagtaccttaactttacttaacctacgtagttactactacctccgtacggtaccgaacggtaccgtacgacgtaggaacgtaacgttaaccgtagtacgtcggtacgtacgaccaccgtacgttacgtcgttaccc

SEQ ID NO: 172528 - DNA, 603 bp, Homo sapiens
  misc_feature: GYAE6OF02JWCDF.27.78.H01.1.454.CMB.1.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
tcagagcgtcgtctcacgaccggtgctcgatttagtgtgagtagtttgggtttggggtatcttaaaagaggttctttctctgggatgtggcatgagcaaaactgacaagtcaaggcaggaagatgttgccatcacaactcattgggtttctgctgctctgggttccacgcctccgaggggtgaaattgtgctgactcagtctccagtactttcagtctgtgactaccaaaggtacgaaaagtccaccatccacctggccggccagtcagngtcgttggtagtagcttacacgtgaccngcagacgcaggtcagtctaccaagcctccncatcaatntcgtcttcccagttcccttcaccggtccggggtccctggacggttcaggtgctagggtcgactcgtggactactacttccacccttcacctactcgaatacgcgtacgacgacctagtaacgcgtagtccgtagtacctactttaacgtacgttaagttcaacttgaaaccgtcgtaacctttacgttacttacggtactaacggtaaccttcgtaaccgttccgaccgtaaacggacctacgaggtacggtaagtaaccgtaaacg

SEQ ID NO: 172529 - DNA, 615 bp, Homo sapiens
  misc_feature: GYAE6OF02H1EIZ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtcctccagtactttcagtctgtgactaccaaaggagaaagtccaccatcacctcggcccggcagtcagagtcgttggtagtagcttacacgtggtaccagcagaacgccgaggtcagtcctaccaaagcctacctcactacaagtatcgccttacctacgttcccttctcgtacgggttcccctcgtacggttcagtcggactaggtgacgtcgtacgggactacgtacttccaccctacacctaactacaactacgtaccgtaggaacgtacgtagaacgtatcgcttacgaccttaaactttacttacttacgtactacgtacgtaatacgttaaccttactttacctacgtagtatacctactaccgttaccggacgaacggtaccgacgtaacgtaggacgttaacgtaaacgg

SEQ ID NO: 172530 - DNA, 593 bp, Homo sapiens
  misc_feature: GYAE6OF02F2NK1.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccgggccagtcagagcgttggatagcttacactggtaccagcagaagccaggtcagtctaccaaagctcctcatcaagtatgtccttcccagtccttctcgacggggtcccctgaggttcagtggctagtggtatcgtgggacactatttccacccgtcaaccctataccaatacgccgtaggaacgtctaggaacgtagtcgactagtacctaactttaagttaccttagtacctatacgacgtaacgttacctttaacctttacctactaagtctactcctaccgttccggaccgtaacggaccgtacgtacgtaggacgtaacgttaaaccgtacgtaggtacggtactcgacctacgtactccttcgtaccttaccg

SEQ ID NO: 172531 - DNA, 712 bp, Homo sapiens
  misc_feature: GYAE6OF02I3T9R.27.78.H01.1.454.CMB.1.raw
  modified_base (143)..(143): a, c, t, g, unknown or other
  misc_feature (143)..(143): n is a, c, g, or t
  modified_base (156)..(156): a, c, t, g, unknown or other
  misc_feature (156)..(156): n is a, c, g, or t
  modified_base (192)..(192): a, c, t, g, unknown or other
  misc_feature (192)..(192): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctggttccagcctccagggtnaattgtgctgctnagtctccagtactttcagtctgtgactccaaagganaaagtcaccatcacctgccgggccagtcagagtcgttggtatacgcttacacgtggtaccagcaagaagtccaggtacagtcctacgaaagctaccncgtatacaagtntcgccttacccacgttccttcgtacgaccggggtcccctacggtaggttccagggtcgacgtaacggtggtaactttcgaggggaacctatacgtttccacctaccacgtaactcaaagtcgttacccgtagaacgtactaaggtaaggacttcggtactacgtaacgttaaacgtttacgtttaccgttagtaccgtaacttaccgaaggttaaccttaaaccggttaacctttttaaccgtaacttaacggtacgttaacctacctaacccggtttaccggaaccggtaaacgggtaaacccaacggtaccgttaaggtaaaccgttaaacgttaaaaccgtaaccgttacggtacgttaaccggtaccgaccgttaaacctacggttccttacggttaacctttaccg

SEQ ID NO: 172532 - DNA, 768 bp, Homo sapiens
  misc_feature: GYAE6OF02I1I4B.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtgaaattgtgctgactcagtctccagtactttcagtctgtagactaccaaaggagaaacgtcacctatccaccgtcggcccgggaccagtcaggagtcgttggtagtagacttacactggtacagcagaagccgaggtcagtactaccaacgtcctacctcactactaagtagtcgtccttacccgacgttcccttccgttaccggtaacccggggttccccgtacggttacggtttccgtaggtcgggtccgtaggttacgggtacgttacggtacggggtacctaaccgttacgttttaccccacccccgttaccacccgtaaactacctaaacgtaccggacccgttaagggtaaacgttaccgttaaggtaacgtacgttcggaccgttacggtaaaccttaaactttacgtttaaccgttacgtaccgtaacttacggtaacgttaaccgtttaaccgtttacccgttttacgtacgttaacgggttacttaacccttacccggtacccgtttaaccgggaacccgttaacggggaacctaaccgggtaacggttaccgggtaaacgttaacggtttaaaacccgg

SEQ ID NO: 172533 - DNA, 788 bp, Homo sapiens
  misc_feature: GYAE6OF02HHOE6.27.78.H01.1.454.CMB.1.raw
  modified_base (146)..(146): a, c, t, g, unknown or other
  misc_feature (146)..(146): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgacctccaaaggagaaagtcacatcactgccggccagtcagagcgttggagtgcttacgntcggaaccngcagaacgccaggtcagtcctacaagctcctcatacaagtatcgtcctccctacgtccctttcgtccgtacggggttcccccttcggtacggttccaagggtcggacgtacggttggtaacttcggtacggggtaacctacgttaacgttttcccaaccccgttcctaaccctaactacccgtaaacgtttacccggaccgttagggaaaccgtcgttaaacgaaggtacgttcggaccttacggtaaccttaaaccgttttacgttaaccgttacgttacctaacgttccgtaaagttaacccgtttaacccttaaacccgttttaacccgttaaccgttaacggttaacctaaccgtttaccccgttaacccgtttaacccggggtaacccggaaacgggtaacccgtaacccggtacggttaacgggtaaaccggttaaaacggtttaaaaacccggtacgttacgggttaccggtaccgttacggaacccgtaacccgttaagtttcccgttacgtttacccgtttaacccg

SEQ ID NO: 172534 - DNA, 602 bp, Homo sapiens
  misc_feature: GYAE6OF02FIYHC.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagcctcctcatcaagtatgccttcccagtccttctccgacggggttcccctcggaggttccaggtcggcaggtggatcgtgggacactagtttccaccctcacctataccaatacgcctaggaacgctagaagactggcctagactaacgttactttacgtcgtacctattacgaagtacgttaaccttaactttaaccctataaacggttctaactccctaaccgttccggaccgtaaacgggacaaccgtacgtaggtaaggtaaacttaaacgtaacgttggtacgtcgtacgcctaacctacgtcttacggtccttaccg

SEQ ID NO: 172535 - DNA, 695 bp, Homo sapiens
  misc_feature: GYAE6OF02ILHM7.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggttctgctgctctgggttccagcctccagggtnaaattgtgctgactcagtctccagtactttcagtctgtgactaccgaaaggagaaagtcaccatcaccgtcggccggccagtcaggagtcgttggtaagtacgtcttaacacgtcggtaccagcgaagagccgaggtcagtctaccaacgctcctacactacgaagttactcgtccttacccgtaacgtttcccttcgtaccggtaaccggggttccccttacggtaaggtttccgaaggttcggacgtaggtacggtacgtcgtacgggtaacctaacttacgtttacccaacccgtacaaccgtactaacgtaacgtacgtaccgtaggaaacgtcgtaagaaagtgtacgtcgtacgtaacttaaacttacgtttaccgtatacgtaactcgtaacgaacgtttaaccttaacctttaccgtacgtagtacgttaccgtaccgttcccgtaaggaacccgtaaggaccaggttaacgtaggtaaacgtaacgtaacgtacggtacgttccggactaccgaaccgttacctagtaccttggttacc

SEQ ID NO: 172536 - DNA, 801 bp, Homo sapiens
  misc_feature: GYAE6OF02F4ZQI.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatccactcgccggccagtcagagcggttggtagtagtcttacacgtggtaccagacgagaagccaggtccagtacctaccaaagtcctacctacagtacaacgttatacgtccttacccgtacgttccctttccgttaccgtaccggggttacccccttcgggtacggtttaccgtacgggttcgggctaacgggttacggtaacgtttccggtacggggtacctaacttaccgttttacccaacccccggtttacccaacccgtaaataccgtaaaacgttacggtacccgttacggggtaaactacggttaacggaaacgttacgtacggtttaccgtaccggtaacttaaaccgtttttaacgtttaccgttacggttaccctaacttaaccggtaaacggttaaccggtttaaccttaaccccggttttttaaccgtaaccgttaaacgggttaactaaccgttacccggttaacccggttacccgggttaacccgggaaacgggtacccgttaaaaccggtacggtaaccggggtaacgttaaaccgttaaaacccggg

SEQ ID NO: 172537 - DNA, 669 bp, Homo sapiens
  misc_feature: GYAE6OF02G7NJG.27.78.H01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaagganaaagtcaccatccacctcggccgggccagtcagagtcggttggtagtagtcttacactcggtaccagcaagaacgccaggtcagtctaccaaacgcctcctcatcaagtatcgtccttccctacgttcccttctcgtaccggggttcccctcggtacgttcgacgtcggctaggtggagtcgtcgggacacgtactttccaccctaccacctacgtacaactaacggcctaggtaacgacgtagaaggatcggctacgtaccttaactttacttaccgtcgtaactagttacctaacgttaaacgttaaccctttaaccgtttttaaccctacgttaaacgttcgtaaccttacccgttaacccgttacccgggaacccgtaaacgggtaccctaaccggtaacggtaacgggttaacggtaaacgttaaacccggg

SEQ ID NO: 172538 - DNA, 676 bp, Homo sapiens
  misc_feature: GYAE6OF02JF1JD.27.78.H01.1.454.CMB.1.raw
  modified_base (181)..(181): a, c, t, g, unknown or other
  misc_feature (181)..(181): n is a, c, g, or t
  modified_base (510)..(510): a, c, t, g, unknown or other
  misc_feature (510)..(510): n is a, c, g, or t
tcagagcgtcgtctcacgaccggtgctcgatttagtgtgagtagtttgggtttggggatcttaaagaggttctttctctgggatgtggcatgagcaaaactgacaagtcaaggcaggaagatgttgccatcacaactcattgggtttctgctgcttctgggttcccagcctccgaggggtnaaattggtgctgactcagtcctcagtactttcagtctgtgacctcaaaggagaaacgtcaaccataccaccgtcggccggaccagtcgacgagtcgttaggtagtacgtacttacacgtacggtaccagtacgaagaacgccgacggttacacgttacctaaccgtaaacgtcctacctacgaactacctaaggttactccgttccttacccgtaacgttccccgttctacccggtaccggggttccccttaggacggtttacgtacgggtcgtacgtacggtggtacgtcggtacgggtactaccgtagttcccaacctacgacctanactaagcgtaccgtaggacgtactagactagtcacgacgtacttaacgtcttacgtacgttctatatacgtaacgttaccttaacgttacctactaggtactaccgtcgttaccgtaccggtaacgtacggaactacgtacggtaacgtacgtaacgttaaaccgg

SEQ ID NO: 172539 - DNA, 588 bp, Homo sapiens
  misc_feature: GYAE6OF02GDHYX.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaagganaaacgtcaccatcacctgccgggcagtcagagcgttggtagtagcttacactggtaccagcagaagccaggtcagtctccaaagcctcctcatacaagttatcgccttcccagtcccttctcgacggggtccccctcgaggttcagtcggcagtggatcgtgggacactatttccaccctcacctatacctaatacgcctaggaacgcttagaagatcgctgacctaatttacttactgtactatacgagtagttaccttaacctttacctacgtaagtgaacttccgtaacccgtttccgggaacccgtaacggggacctaaccggtaacgtacgggtaagtaacgtttaaaacccgg

SEQ ID NO: 172540 - DNA, 723 bp, Homo sapiens
  misc_feature: GYAE6OF02IXIVW.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgcccatcacaactcattgggttctgctgctctgggttccagcctccgaggggtnaattgtgctgactcgagtcctacagtactttcagttctgtagacctaccgaaaggagtaaagtccactagtccaaccgtggcccgggactaggtacgaggtacgtcggttaggtagtacgtaccttacgacgtacggtactagacgaagacgacgtaggtactacgtacctaaccgaacgtcctacctactacgtactaacgtacgtacgtacccgttaccgtacgttacccgttaccgtaccggtaccggttacccgtacggtacgttacgacggtacggtaccgtaggtacgtacgtacggtacggtactaccgtacgttacccaccgtacctaacctacgtacgtaacgtacggtaccgtacggtacgtacgtacgtaacgtagtacgtctacgtacttaaccgttacgttacgtacgtacgtagtacgtaacgttaacgttacttaaccgttactacgtaacgtacgtaccgttaccgtaaccgttaccggtaaccgtacggtaccgtaaccggtacgtacggtaaccgtaaggtaacg

SEQ ID NO: 172541 - DNA, 837 bp, Homo sapiens
  misc_feature: GYAE6OF02HUNU4.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtnaaattgtgctgactcgagtcctccagtactttcagtctgtgactaccgaaaggagaaagtccaaccatccaaccgtcggcccggggacctagtccaggacggtccgttttgggaacttacggtcctttaaccgacgttacgggtaacccaggaccgaagaacgtcctagggtccacggttacctacccgaaagtccctaccgtacaagtactaacgttagtcgtacccttcccgtacggttccccttcggtaccggtacccgggtttccccccttaagggtaccggtttcgtacggtcggaccggttaggtacgggtaccgtacggttcggggaaccttaaccttaccgtttcccaacccttaccgaaccctagttaaccgtaaacggttacggaccgttagggaaccgtagtaaccggtaaagtcgtacggtaccttacggaccttaaacgtttcgtaacttacggttacctaacgttaccgaaacggtttaaccgtttaccgttaaacccgtttacccgtaccgtaaaggtacgttaacccgttaccttacccgggttaccggaacccgaaccgggggtacccaacgggttacgttacgggtaacgttaaaaccgttaaccggacgttacgggttccggtacttaccgggaccctaccgtacgtttacccgtagtttaccccttacgg

SEQ ID NO: 172542 - DNA, 607 bp, Homo sapiens
  misc_feature: GYAE6OF02HL2HP.27.78.H01.1.454.CMB.1.raw
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaaattgtgctgactcagtctccagactttcagtctgtgactccaaaggagaaagtcaccatcacctgccgggccagtcagngcgttggtagtagcttacactgtaccagcagaagccaggtcagtctacaaagctacctcatacaagtatcgctccagttcctcncgacgggtcccctgacggttcagtcgctagtggatcgtggacacgtaatttccaccctcaccactacgaatcgacctaggaagtctaggaagtatgtactgactaacttaattactgtacattaccaaggaacgttacctttaaccgtttaacctcgtaagtaccgtactaccgttaacccggttacggaacccgaaacggggtaccaccgggtacctaaggggtaaactaacgttaaaactaaacccgttggtaacgcgttacggaccctaacccttagttcccttgttaccc

SEQ ID NO: 172543 - DNA, 857 bp, Homo sapiens
  misc_feature: GYAE6OF02HSYAE.27.78.H01.1.454.CMB.1.raw
  modified_base (148)..(148): a, c, t, g, unknown or other
  misc_feature (148)..(148): n is a, c, g, or t
  modified_base (249)..(249): a, c, t, g, unknown or other
  misc_feature (249)..(249): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtnaaattgtcgctgactcacgtctccagactttcagtctgtagactaccgaaaaggacgaaagtccaaccagttccaccgtcgggaccgggcctagtcgaagnggtccggttggtaagtgtccttaacaccgttgggtaaccaggtacgaacggaaacgtcccgtaagggtcctaacggtccttacccgaaaacggtccttacctcgtaataccgtaaagttacgtcgtaccttacccgtacgttcccttaccggttccggtaacccgggggtttccccccagggttaaccgggtttaccgaacgggttcggggaaccgtaagggttaccgggtagtttaccggacgggggtaaccttaaccgttacttttacccgaacccccggttactaaacccgtaacgttacgaaacggttacccggtccgtaacgggtaacgtaccgtaagggtaaacgtcggttacgtacccgtagaaccgttaacttacgttaacgttaccgtacgtaacttcgtaaacgtacggttaaacctttaaccgtttaacccttacgtaacggtcttaaccgtaacccgtttaccgttaaccgggaccggtaaaccgggtaacgtaccggtaccggtaaggttaacgtaaaacggttaaaccgtaccggtacggttacggaccttaccggaccgtaccgttaacctcggttacctttaccgttaaccg

SEQ ID NO: 172544 - DNA, 637 bp, Homo sapiens
  misc_feature: GYAE6OF02F5GYE.27.78.H01.1.454.CMB.1.raw
  modified_base (298)..(298): a, c, t, g, unknown or other
  misc_feature (298)..(298): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgcccgggccagtcagagtcgttggtaggtagcttacactggtaccagcagaagccaggtcagtctccaaagctcctcatcaagtntcgccttcccagtccttctcgacggggtccccctcggtacggttcaggtcggcctaggtcggtactcgtcgggactacgtactttccaccccgttcaaccctatacaatacgaccgtaggaacgcgtagaagacgtcgacgtagacctaactttacttattcgtctaatacgtaagtacgttaacttacctttaacctacgtaacgttcgtaactccgtaacccgtttacggaaccgaacggaccgtaacgtacgtacgggtaacgtaaaccgttaaacggaaccgttaggtacggtacgtacgtacgtaaccctattccgttacgttacctttacccg

SEQ ID NO: 172545 - DNA, 632 bp, Homo sapiens
  misc_feature: GYAE6OF02JFLGQ.27.78.H01.1.454.CMB.1.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (321)..(321): a, c, t, g, unknown or other
  misc_feature (321)..(321): n is a, c, g, or t
  modified_base (486)..(486): a, c, t, g, unknown or other
  misc_feature (486)..(486): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
tcagagcgtcgtctcacgaccggtgctcgatttagtgtgagtagtttgggtttggggatcttaaaagaggttctttctctgggatgtggcatgagcaaaaactaacaagtcaaggcaggaagatgttgccatcacaactcattgggtttctgctgctctgggttccagcctcaggggtgaaattgtgctgactcagtctccagactttcagtctgtgactacgaaagganaaagtcaccatcacgtcgccgacagtcagngtcgtggtagtagtctacatacggtaccagcgagagccgaggtcagtactaccaacgctcncatacaagtctcgtccttccagttcccttctaccggtaccggggttcccctagggtacggttacgacggtacggctacggtagactcggtacgggaacctagttactttcccaccgttaaccacctaactactaacggtacgtccgtaggaacgttcgataacgnttgcgtcaacgtaattacttactagtactagtagtaaccgtacgttaacttaccttaccgtanacggttacncttaaccgtcccgttaccggaaccggtaaggtaccgaacgtaccgtaacggtaacgttaactaacggtaaccgg

SEQ ID NO: 172546 - DNA, 699 bp, Homo sapiens
  misc_feature: GYAE6OF02F1F7C.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactcggtaccagcagaagccaggtcacgtctaccaaagctcctcatacaagtatgtccttaccacgtccttcgtcgtacgggtcccctcggtaggttcgagtcggcaggtcggactcggtcgggactaactcgtttacacccctcgacctataactaacgtacgccgtaggaacgctaaggaagactacggactaggtaacctaacgtttacttacgttagtactactacgtaagtaacggttaaccttaaccgttttaaccgtaactaaacggttacgtaaccttacccgttaaaccgttcccgggtaaaccggtaaaccgggtaccgtaaacccggttacgtaacgggttaaacggtaaacggttaaaaccggtaaaccgttacgggttaacggtaccgtacggtaacccgtaaccgttacgttacccgtttacggttacccgtttaacccg

SEQ ID NO: 172547 - DNA, 564 bp, Homo sapiens
  misc_feature: GYAE6OF02GQW9Z.27.78.H01.1.454.CMB.1.raw
  modified_base (292)..(292): a, c, t, g, unknown or other
  misc_feature (292)..(292): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggagatgttgccatcacaactcattgggtttctgctgctctgggttcccagcctccgaggggtgaaattgtgctgactcagtctccagactttcagtctgtgactccaaaggagaaagtcaccatccacctggccggccagtccagagcgttggtagtagtcttacactggtaccnggcagaagccaggtcagtctaccaaagctcctcatcaagtctcgccttcccagttcccttctcgaccggggtcccctcggaggttcaggtgcaggtggatcgtgggacactatttccacccctcacctatcaatcgccgtaggaagctagaacgatcgctagctaacttagttactgtcatcagtacgttaccttactttaccacgtaagtctacttccgacccgttccggaccgaaggacctaacgacgtcggtaacgtaacttaaaccgg

SEQ ID NO: 172548 - DNA, 621 bp, Homo sapiens
  misc_feature: GYAE6OF02HPAKJ.27.78.H01.1.454.CMB.1.raw
  modified_base (424)..(424): a, c, t, g, unknown or other
  misc_feature (424)..(424): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcacatcacctgccgggccagtcagagcgttggtagtagtcttacacgtggtaccagcaaggaagccgaaggtcagtctaccaaacgcctcctacatcaagttatcgtccttcccacgttccttcgtccgtacggggttcccctcggtacgttacgtaggtggcgagtggtatccgtggactactacttccaccctcacctatacatacgactggaacncgtagaagtatgtactcgtactaacgttacttaacgtgtactagtacagtacttaccttaacttacctatagtcgtactccgtacccgttacggaaccgtaacggtacaacgggtactaacgggtaaagtaacttaaaaccgggattacgggtcgttaagtccggaccgtaaccctagtttaccgtaccgttacccg

SEQ ID NO: 172549 - DNA, 622 bp, Homo sapiens
  misc_feature: GYAE6OF02J2FRH.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctcaaagctcctcatcaagtatgcttcccagtccttctcgacggggtcccctcggaggttcaggtgccaggtggatcgtagggacctacgtacgttttccaccccgttacaaccctaattccaaaagttacgtaccgtacggaagtaccgtagtaaagactgaccgttagacctaaacttttagtaacttgtacctataccgtagtaacgttacctttaacctttaccacgttaagtacgtaactcctacccgtttcggaccgaaacgggtacgaccgtacgtacggtaagtaacgttaaaccgacgtggttacgcggttagaccctaccgtactccgttgttaccttacc

SEQ ID NO: 172550 - DNA, 631 bp, Homo sapiens
  misc_feature: GYAE6OF02II1ZN.27.78.H01.1.454.CMB.1.raw
  modified_base (154)..(154): a, c, t, g, unknown or other
  misc_feature (154)..(154): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
  modified_base (424)..(424): a, c, t, g, unknown or other
  misc_feature (424)..(424): n is a, c, g, or t
tcagagcgtcgtctcacgaccggtgctcgatttagtgtgagtagtttgggtttgggggggcatgagcaaaaactgacaagtcaaaggcaggaagatgttgccatcacaactcattgggttttctgctgctctgggttccagcctccgaggggtnaaattgtgctgactcagtctccagtactttcagtctgtgactccaaaaggagaaagtcaccatcaccgtggccggccagtcagagtcgttggtagtncttacactggtaccagnagaagccaggcagtctccaaagtctcctcatacaagtatcgccttccctagttccttcgtcgaccgggtccccttcgagttcaggtggcaggtgatcgngggtacacgtattcaccctcaccatacaacgtagacgtggaacgcgtagagatcgtntacgtctaactttattactacgtactactctaagtaccttaacttaccctttaactactaaacggttacgtaacttcccttaaacccggtttacggaacccggtaaggggaaccacggtaacggttacgggaaaacgttaaattaaaccggtaacgttacgggtacggttacgtacgaaccctaaccgtatttccgtacctttacgg

SEQ ID NO: 172551 - DNA, 658 bp, Homo sapiens
  misc_feature: GYAE6OF02IO1IN.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtgacctaccgaaaggagaaaacgtcaccatccaccgtgccgggccagtcagagtcgttggtagtagcttacactggtaccagcagagccaggtcagtcctccaaagcctcctcatcaagtatcgtaccttcccacggttcccttcgtaccggaccggggttcccctacggtacggtttccgagggtcgactaggtaggtacttcgtaggggaacctacgtaactttcccaccccttacaacccgtataccgtaaacgtacgtccgtaggaacgtcgtaagaagtctacgcgtagactaacgtttatacgttagtactacgtacgtacgtaacgttacttaaccgtttaccacgttaaggttcgtaaccttacccgttaacccgttaccggaaccgtaaccgggactaccggtaacggtacggtaacgtaaccgttaaaccgg

SEQ ID NO: 172552 - DNA, 555 bp, Homo sapiens
  misc_feature: GYAE6OF02HPN5B.27.78.H01.1.454.CMB.1.raw
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctaccaaagctcctcatacaagtatgcttcccagtccttctcgacgggtcccctgaggttcaggtggcagtggatcgtagggacactatttcaccctcaccatcaatacgaccgtaggaacgctagaagatgctgctaacttattacttgtcatcanacgtacttacttacctacaagtnactactaccgttcggacaaagggacacgacgttaggaagtaacgttaaacggaacgttaggtggtacgtacggacctaacccgtattcgttacgttccttaacc

SEQ ID NO: 172553 - DNA, 558 bp, Homo sapiens
  misc_feature: GYAE6OF02FKRP3.27.78.H01.1.454.CMB.1.raw
  modified_base (339)..(339): a, c, t, g, unknown or other
  misc_feature (339)..(339): n is a, c, g, or t
  modified_base (541)..(541): a, c, t, g, unknown or other
  misc_feature (541)..(541): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctcgaggttcagtggcngtggatcgtgggaacactacttccaccctcaccacttcaatacgcctaggaacgcgtagaacgtatcgactagtactaacttattactgtctatcgagtacgttaaccttactttaccactaagtctacttactaccgttcgaccgtaagggacctacggacgtaggaacgtaattaacgaacgtgcggtactcgcctaacncttctagttccttaacg

SEQ ID NO: 172554 - DNA, 696 bp, Homo sapiens
  misc_feature: GYAE6OF02ICRYO.27.78.H01.1.454.CMB.1.raw
  modified_base (334)..(334): a, c, t, g, unknown or other
  misc_feature (334)..(334): n is a, c, g, or t
tcagagcgtcgtctcacgaccggtgctcgatttagtgtgagtagtttgggtttggggatcttaaaagaggttctttctctgggatgtggcatgagcaaaaactgacaaggtcaaggcaggaagatgttgccatcacaactcattgggtttctgctgcttctgggttccagcctccaggggtgaaattgtgctgactcagtctcagactttcagtctgtgactaccaaaggagaaagtcaccatcaccgtgccggccagtcagtagcggttaggtaggtagcttacactcggtaacagacaagacgccgaggtacacgtctaccaaagcctccanactcaagtatctccttccacttccttcgtacgaccgggttccctaggtacggttcaggtcggtactagggtcgtaagtccgtagggtaacctacctaacgtttccccaacccgttacaacccgattacgtaaacgtaccgttaccgtaggaacccgtacgtaacggaagtacgttacgaccggttacgtaaactaacgttttattaccgtagtttaacctagttaactaaacggttaacttaaccgttttaacccttacgttactaacgtaccgtttactacccgggttaccgtaacccgggtaccgtaaccgggaacctaaccggtaacggtaacggtaaacttaaccgttaaaacccggg

SEQ ID NO: 172555 - DNA, 708 bp, Homo sapiens
  misc_feature: GYAE6OF02GPGWB.27.78.H01.1.454.CMB.1.raw
  modified_base (493)..(493): a, c, t, g, unknown or other
  misc_feature (493)..(493): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatcacctcggccgggccagtcagagtcgttggtagtacgtcttacacgtacggtaaccagcaagaacgccgaggtcacgtcctaccaaagcctcctacatacaagtatcgtccttcccacgttccttcgtccgtaccggggtcccctcggtacggttcgaggtggacgtaggtggtatcggtagggacacgtacttccaccctcaacctactacaactacgccgtaggtaacgtcgtaggaagtacgtcgacgtacgtaaccttaactttagttaccgttnttaacactacgtaacgttaaccgttaacctttaaccgtttacccgttaacgtaagttacgtaaccgtttacccgttaaccggttaccggaaccggtaacgggtaaccgtaccggtaacggttaacgggtaaacgttaaacgttaaaccggtaacggtttacgggacgttacgtaccgtaaccgtaacccgttactttaccggtaccgtttacccg

SEQ ID NO: 172556 - DNA, 635 bp, Homo sapiens
  misc_feature: GYAE6OF02I3F9M.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtgaaattgtgctgactcagtctccagtactttcagtctgtgactcaaagganaaagtcacatcactgcggcagtcagagcggttggtagtagtctaacacgtggtaccagcagaacgccaggtcagtctaccgaaacgtctcctcatacaagtagtactccttcccacgtccttactcgtacgggtccccgtcgagttacgagtggacgtagtggactcgaggtaccactactttaccacccgtacaaccgaactacaacgtacgaccgtaggaacgtacgagaaaggtatacgtccgttacgacttaaaccgttaacgttaactacgttactaactacgaacgtacgttaccttaaccgttaacttacgtaagtcgtaacgttactaccgttaccgaaccggtaaggtaccgacgtacgtaggaaaggtaactaaaaccgtacgtagtacgtacgtacgtaccgtaacctacgtcttacgttaccttaccg

SEQ ID NO: 172557 - DNA, 585 bp, Homo sapiens
  misc_feature: GYAE6OF02HTGBU.27.78.H01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagactttcagtctgtgactccaaaagganaaaagtcaccatcacctgcccgggccagtcagagcgtttggtagtagcttacactggtaccagcagaagccaggtcagtctccaaagctcctcatcaagtatgcttccagtccttctcgcgggtcccctcgagttcagtcggtacagtggatcgtgggacactactttccacccctcacccataccaatacgcctaggaaacgtcgtagaaagatcggacctcgactaaactttactttactagttccaacttcgaagtagttaaccttaccttttacctactaaggttacgactccgtaacccttcggaccgaacgggaccaaccggacttacgggacgtaagttaaaaccgg

SEQ ID NO: 172558 - DNA, 718 bp, Homo sapiens
  misc_feature: GYAE6OF02IZH4L.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtgaaattgtgctgactcagtctaccagactttcagtctgtgactaccaaaggagaaacgtcaccactacaccgtcgccggaccagtcagagtcggttggtaagtagcttacacgtacggtaccagcaagaacgccgaggtcacggtcctaaccgaaaacggcctacctacactaccaagttatacgtcttacccgtacgttcccttccgtaccgtaccggggtccccttacggacgggtttcgtaagttcggacacggttcggtaacgttcggtagggaccctaacgttacttacctaccccgtcaacctactacgaacgttaccgacgttagaacgtccgtagaaacgacgtagactacgtaacttaacccttaatttaaccggtacttacgtaaccttacggtaaacggttaaccttacgttaacccgtttttacaacgttaacgttacggtaacgtttccctaaaccccgttacggaccggtaaaacgggtaccctaaccggtaacggttaacggtaaccgtaaacggtttaaacccgg

SEQ ID NO: 172559 - DNA, 680 bp, Homo sapiens
  misc_feature: GYAE6OF02JIWMP.27.78.H01.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (342)..(342): a, c, t, g, unknown or other
  misc_feature (342)..(342): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagtactttcagtctgtgactcaaagganaagtcacatcactgccggcagtcagngcgttgtagtagcttacactgtaccagcaagagccaggtcagtactccaaagctcctcagtacagtatcgtccttcccatccttaccncgtaccggggttcccctaggtacggttcacgggtggccgaggttcggacttcggtacgggtactaaccgtacgtttcccgtaacccctctaacccgtataccgtaaactaccgtaccgttagggtaacggtacttaacgggtaaacgacgttacggtaccgttacgtaccgttaaactttaaccgtttaacgtcggttaactaacgttaccgaaggttaacgttacctttaacccgtttacctaaccgtaacgttccggtaacttaccgtacccgtttaccggaaccgtaacgggtaacctaaccggtaacgtacggtaacgtaaccgttaaaaccgg

SEQ ID NO: 172560 - DNA, 785 bp, Homo sapiens
  misc_feature: GYAE6OF02I3I8U.27.78.H01.1.454.CMB.1.raw
tcagagcgtcgtctcacgaccggtgctcgatttagtgtgagtagtttgggtttggggatgagcaaactgacaagtcaaggcaggaagatgttgccatcacaactcattgggtttctagctgctctgggttccacgcctccaggggtactaattgtgcttgacctcgagtcctccaggactttcagtctgtgactacgaaaggagaaacgtccaccatcgaccgtggcccgggacacgtcaggacgtcggttacggtaagtacgtacgttaaccgacgttacggtaaccgacgtaccgaaggaacggaccccgtaagggttacctaaggtcctaccccgaaaaggtccttaccctacctaagttacctaaagttaccgtaggtacccttacccctaccggttacccgtttaccgttaccggttaaccgggggtcccccccgttagggtaccggttttaccgaacggttcggaccgtaggttacgggaacttccggttacggggacctactaacgttttacccgaaccctcaacctacgtaccaacgttacgtaccgtaggaaacgtcgtaacggaagtacgtcgaccgtacgtaccgttaaacgttactttacgtacgtacctaacgtactaagttaccgttaacttaaccgtttaccgagttaacgtgtaacctccgttaccgttaccgggaacccgtaaggaccgtaacgacgtaaggtaacgtaacgtttaaacgacgtacggtagtccgacgtaccgtaccgtcgtcgttcttcgttacccg

SEQ ID NO: 172561 - DNA, 716 bp, Homo sapiens
  misc_feature: GYAE6OF02HURDT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcgagtctgtgactaccaaaggagaacgtaccaccatcctaccgtcggccgggccacgtcaggacgtcggttggtagtacgcttacactggtaccagacaagaacgccgaggtaccaggttacctaccgaaagcctacctacactacgtaagtactcgtcccttaccctagttcccgttcctcggtaccgggttccccgtcggtacggttacgtaggtcggtcgtaggtcggtacgtcgtacgggactaaccgttacttacccgaccctaccctaacccgtacttaccgtaaactaccggtaccggttacggaaccgttacgtaaggtaagacttacggtacctaacgggtaaccttaaacgttttacttacgttacggttactacgttaacgtacgtaaactttacccttacctttaccgtacgtagtacgtacttaccgtaaccgttaccggaccggtaaacgggacctacggtacgtacggtaacgtaaacgttaaccgagtagttcgcgtacgactaccgtagttccctgttcctac

SEQ ID NO: 172562 - DNA, 669 bp, Homo sapiens
  misc_feature: GYAE6OF02GZQEO.27.78.H01.1.454.CMB.1.raw
  modified_base (320)..(320): a, c, t, g, unknown or other
  misc_feature (320)..(320): n is a, c, g, or t
  modified_base (371)..(371): a, c, t, g, unknown or other
  misc_feature (371)..(371): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactacaaaggagaaagtcacatcactgccggcagtcagagtcgttaggtagtagcttacacgtggtaccagcagaacgccaggtcagtctacaaagtctcctcatacaagtatcgtccttcccagttcccttcncgtaccggggtcccctaggtacggttcgaggtcggcgtaggtggacttcgngggactacgtactttacacccctacaccactacaagtaccgcgtacggaacgtacgtacgaagtatcggtactacgtaaccttaaacgtttacttaaccgttacgttactaacgtccgtaaagtaccgttaaacttacctttaacccgtacgtaaacgtacgttaccttaccgtacccgtttaccggaccgtaaacgggtaacctacggtacgtagggtaacgttaaaccgttaaaacggacgttcgggtaagtaccgttacgaccgtacctaccgttcttacggttacccttacccg

SEQ ID NO: 172563 - DNA, 806 bp, Homo sapiens
  misc_feature: GYAE6OF02HG4XI.27.78.H01.1.454.CMB.1.raw
  modified_base (185)..(185): a, c, t, g, unknown or other
  misc_feature (185)..(185): n is a, c, g, or t
  modified_base (366)..(366): a, c, t, g, unknown or other
  misc_feature (366)..(366): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcgaggggtgaattgngctgactcagtcctccagtactttcgagttctgtagacctaccgaaaagggataaagtccaaccatccaccgtcggcccgggacagtacgagaggtcgttggtagtacgacttacacgtcggtaccagcaagaacgccgaggtcacgtcctaccgaaacgtcctaccctacactacaagtntcgtcccttaccgtacgtttcccttccgtaccggtaaccgggttcccccgtaggttacgggttaccgtaggttacgggcgtacgggttggacggtttccggtacgggaaccctacgtttaaccgtttcccaaccccgttaccgaacccttaactaccgtaacgttaccggtaccgtaagggtaaactacgttacgaaacgggtactacggtaccgtaacgttacccgttaaacgttttaccgttttaacgtccgttaacccgttaagttaaccggtaaacggtttaaacctttacccgtttaaccgtttttacccttaacggtttaaccggttaacttaacccgtttccccgttaaacccgggttcccggtaaacccgggtaacgggttacccgaacccggttaacgggtaacggttaacggtaaccgtttaaaaccggg

SEQ ID NO: 172564 - DNA, 838 bp, Homo sapiens
  misc_feature: GYAE6OF02IZ2ZS.27.78.H01.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttnagtctgtcgactaccaaagganaaacgtcaccatccacctcggccgggcagtcagacgtcggttaggtagtagtccttaacaccgtcggtaccaggtccaaggaacgcccgaggtccaacgttcctaccaaaaggtccttccctacaacttacgaaagttacgtcggtcctttaccccgtacggtttcccctttccgtcccggtaaccgggggttccccctacgggtaacgggtttccgagggttcgggaccgtaggtacgggactttcggtacggggaacctaacgtacgttttacccaaccccgtacctaaaccctacgtactaaacgttacggtacccggtaagggtaacgtccgttaaggaaacgtacgttacgtccgttaggtaccctttaaaccgttttattaaccgtttcggtaacctacgttacgaaagttaccgtttaacccttttaaccttttaacccgtaacgttaacgttacgtaaccgtttaccctaaacccggttttaccgggaacccggtaaacgggtacccgtaacggttaccgggttaacgggtaaacggtttaaaccggttaaaccggttaaacggttcgggttaacgggtacgttaccgacccgttaaccgacgttttaccgttacgtttaccctttaacccg

SEQ ID NO: 172565 - DNA, 708 bp, Homo sapiens
  misc_feature: GYAE6OF02JKTWK.27.78.H01.1.454.CMB.1.raw
  modified_base (256)..(256): a, c, t, g, unknown or other
  misc_feature (256)..(256): n is a, c, g, or t
  modified_base (672)..(672): a, c, t, g, unknown or other
  misc_feature (672)..(672): n is a, c, g, or t
tcagagcgtcgtctcacgaccggtgctcgatttagtgtgagtagtttgggtttggggggtcgatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcactgccggccagtcagagcttggtatagctagactggtaccngcagaagcgacgtcagtctacaaagcctccttacactacaaggttactagtccttcccgaagttccttcctcgaacccgggggttcccctaccggtaaggggtttccaagggttacggcctaaacggttgggaacgttccgttacgggggtaccaaccttacgttttacccaaccccgtcctaaaccctaaccttacgtaaacgttaaccggtacccgtaacgggaaacgtacgttacgggaaactaacggttacgtacgttacacccgttaaaacttactttaaccgttacggtactacgttacaacgtaacgttaaccgttaaccttttaccacgtaacgttgtaactacctaccgtttacccggaacggtaaaccgtagtacgacttagggaccttaaagtaaaccggtaccnggttaccgagtacgacctacctacgtctacgttccg

SEQ ID NO: 172566 - DNA, 757 bp, Homo sapiens
  misc_feature: GYAE6OF02IYDWG.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcatccaggggtnaaattgtgctgactcagtctccagtactttcagtctgtgactcgaaaggagtaaagtcacatcaccgtggccggcagtcaagcgcgttaggtagtagtacttacacgtggtaaccaggacaaggaacgaccgtaggtacctacgtaccgttaaccaaaacgtccttaccctacaacgtaccgtaaagttactcgtacccttacccgtacgtttcccgttcgtacggtaccggggtttcccctacgggtaacggttcgtaacggttggaccgtaggttacggactttccggacgggtaacctacgttacctttaccgaacccttcgtaaaccctagtacctaacgttacggaaccgttagggaactccgtaaaggtaacgtacgtcgacgtaaccgtaacttaaaccgtttagttaacgttacggttactaaccgtactaacggttaaccgttaactttaacccggtttaacctacgtaagttaccgtacgttaccgtaaccgttcggtaaaccgaacgggacctacggaacgttacgggaaacttaaacgtaacgtaacggttacggttcggacgttaacgaccgttaaccgtaacgttccgttagttccc

SEQ ID NO: 172567 - DNA, 842 bp, Homo sapiens
  misc_feature: GYAE6OF02JE4OM.27.78.H01.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtntaaattgtgctgactcagtctccagtactttcagtctgtgactccaaagganaaagtcaccatcaccgtggcccggccagttccagagtcggtttaggtactaagtccttaacaccgttggaacccaggtaccagaacggtccaagggtccaaggttcctaccctaaaacggcctacccctccgtaagttaccgtaaacggttattcggtccctttaccccgtaaggttccccttttacggtaccggtaacgggggtttcccccctaagggtacgggttccgtaacgggtttaggcccgtaaggttcgggaaacgttcgttacgggggaaaccttaccgtaacgtttttaccccaaccccgttaccgtaacccctacttaacccgaacgttttaaccgacccgtttaacgggtaaacggtacccgtttaacgggaaagtaccgtaggtaccgttacgaacccgttaaacttttaacgtttaacccgttagttactaaacgtccgtaagttaccggttaacctttaccgtttaaaccgttccgtaaacgttaaccgttacgtaaccgttaaccctttaccgggaaccgtaaacggggtacctaacggtacttaaccgggaagttaaacggttaaaccgtaacgttacgtacggtttaccacggtacaccgttacggtacttacgttacccgttacc

SEQ ID NO: 172568 - DNA, 643 bp, Homo sapiens
  misc_feature: GYAE6OF02JBI9U.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaccatcacctgccgggccagtcagagcgttggtagtgcttacactggtaccagcagagccaggtcagtctccaaagctcctcatcaagtatcgcttcccagtccttctcgacggggttcccctcggtaggttcagtcggctaggtggtatcgtcgggactactagtttaccacccgttacacccgacttacaacttacgacccgtagggaacgtccgtaggaaacgtatcgaccttagacctaaacctttagtttaacttgtactactacgtaacgtacgtttaaccttaccttttaaccctacgtaacgttacgtacttaccctaacccgtttccggaaccgtaacggggacccacggtaccgttacgggaacggtaaccttaaaacggtacgttgttacgggtactacggacctacccgtattccgttagttacccg

SEQ ID NO: 172569 - DNA, 630 bp, Homo sapiens
  misc_feature: GYAE6OF02HCHQG.27.78.H01.1.454.CMB.1.raw
  modified_base (227)..(227): a, c, t, g, unknown or other
  misc_feature (227)..(227): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctcagtactttcagtctgtgactccaaaggagaagtcacatcacctgccggcagtcagngtcgttggtagtagacttacacgtggtaccagcagaagccaggtcagtctaccaaagctctcgatcgaagtatcgcttcccgagttcccttcgtcgacggggttcccctggtacggttcaggtggcaggttggactcgtagggactactacgtttaccaccctacaccatacgaactacgaccgtaggaacgccgtagaagtataggactaggtacctaactttacgttactagttacctaattaccgaagtacgttaaccttacctttacctactaaggtctacttaccgtaccgttccggaaccgaacggtacctacggtacgtagggtaactaacggtttaaaccgagttacggtacggtacgtacgaccgttaaccgtcgttaccgttacgtttacccg

SEQ ID NO: 172570 - DNA, 558 bp, Homo sapiens
  misc_feature: GYAE6OF02GWFR6.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggccagtcagagcgttggtagtagcttacactggtaccagcagaagccaggtcagtctccaaaagctcctcatcaagtatgcttcccagtccttctcgacgggtccctgagttcaggtgcagtgactgtggactactactttaccaccctcaccatacaatacgcctaggaacgtctaggaaagtatgtacgtacgtactaacttacttactcgtactagtcaacgtacgttaccttaacctttacctactaagtcgtaacttccaccgttccggaccgaaaggacgacgtacgtaggaacgtaactaaacgtaatggtacgatcgacacatctgtacttacg

SEQ ID NO: 172571 - DNA, 643 bp, Homo sapiens
  misc_feature: GYAE6OF02GENSH.27.78.H01.1.454.CMB.1.raw
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
  modified_base (615)..(615): a, c, t, g, unknown or other
  misc_feature (615)..(615): n is a, c, g, or t
  modified_base (627)..(627): a, c, t, g, unknown or other
  misc_feature (627)..(627): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccatccaccgtgcccgggaccagtcaggagtcggttggtacgtagtccttaacacgttcggtaccagacgagaacgccgaggtactacggtctaccaaagtctccctacatactaagtatcgtaccttccctaggttcccctttcgtaccggtaccggggttcccccttacgggtacgggtttcccgtaagggtcggtacggtaggttacggtactcgggtagggacctacgttactttaccacccctactacccaatacaacgtcgtaccggtaggaactcgtagagtcgtgctagactacttatcgttnactactanagtactaccttaacttacctatgtcgacttccctaccggttgacccgtaagaccgaccgtgacggacgtaacgtaacgtacggtgtacgntcgacctacttnacgtttcgacgttacc

SEQ ID NO: 172572 - DNA, 672 bp, Homo sapiens
  misc_feature: GYAE6OF02GO5OF.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccgaaaggagaaagtccaccatcacctgccgggcagtcagaggcgttggtagtagcttacactggtaccagcagaagccaggtcagtctaccgaaagcctccgtcactcaagtatcgccttcccacgttcccttcgtcgtaccggggttcccctaggtacggttcaggtcggcgtaggttcggattaccgtacggggaacctacgttactttacccgacccctacgaaccctactaccgtaaacgtaccgtacccgtagggaaacgtccgttaaggaacggtagtacggcgttacgacttaactttaacgtttacgttgtacctagtacgacgttaaccttacctttaacctttaccgttactaacggtagttacctccgtaaccctttaccggaacccggtaacgggacccgtacggtaacccgttagggtaacttaacggttaaaaccgg

SEQ ID NO: 172573 - DNA, 645 bp, Homo sapiens
  misc_feature: GYAE6OF02F4FPS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacacgtggtaccagcagaacgccaggtcagtcctaccaaagctccacatcaagtactgtccttcccacgtccttaccgtccgtacggggtcccccttcggtaggttccgaggtcggcaggtggatcgtaggacacgtactttccacccctcaaccctatccgaaatacggtccctaggtaacgacgtagaaaggtactcggactacgtacctaacgttacttaacgtctacataccgaagtacgttaaccttaaccttttaccacgtaaacgttcgtaactcctaaccgttccggaaccgtaacgggacctacggacgtaggaacggtaacgttaaaaccggtacgttacggttacggtacgttacggacccgtacgtagttccgttaccggttacttacccg

SEQ ID NO: 172574 - DNA, 622 bp, Homo sapiens
  misc_feature: GYAE6OF02JS7IB.27.78.H01.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggnaaagtcaccatcacctgccggccagtcagagcgttggtagtagccttacactggtaccagcagaagcagtcagtctccaaagctcctnatcaagtatgccttcccagtccttctcgcgggtcccctcgaggttcaggtgcagtggatctagggacacgtacttcaccctcacctatccaatacgtccgtaggaacgtcgtagaaagctcgacgtagactaacgttattccttagttacactacgaagtacttaaccgttaacttttaccctacgtaacgttacgtacgttaccttaaccggttcggaaccctaaacgggtaaccctaacggacgttacgggaacgttaaacgttaaaaccgacggttaacggttacggtaccgtacggacctaaccggtatttacccgttagttaccctttaacccg

SEQ ID NO: 172575 - DNA, 721 bp, Homo sapiens
  misc_feature: GYAE6OF02JKXG4.27.78.H01.1.454.CMB.1.raw
  modified_base (149)..(149): a, c, t, g, unknown or other
  misc_feature (149)..(149): n is a, c, g, or t
  modified_base (257)..(257): a, c, t, g, unknown or other
  misc_feature (257)..(257): n is a, c, g, or t
  modified_base (469)..(469): a, c, t, g, unknown or other
  misc_feature (469)..(469): n is a, c, g, or t
tcagagcgtcgtctcacgaccggtgctcgatttagtgtgagtagtttgggtttgggggtcgatgagcaaaactgacaagtcaaggcaggaagatgttgccatcacaactcattggttttctgctgctctgggttccagcctcaggggtnaaattgtgctgactcagtctcagtactttcagtctgtgaccacgaaaaggagaaagttccaccatcacctggccgggtccagtcaggacgcgtttgggagtagcttanacgttggtaccaagcagaacgccgaggtcacgtctaccaaagcctaccttcatacagtatcgtcttccacgttccgttctcggtaccggggttacccctggtaacggtttcgacggtacggtccggtagttcggtaatccggtagggtaacctaacgtacttttaccaaccccgttccaactactacgtaaacgtacgccgtagggtaaacnccttaaggaacgtacgtgtacgacgtaaccttaactttaacgttacttaacgtaccttacggacttaaacgaggtttaaaccccttacggtttaacccttaacggtacgttaacgaaccgttccgttaacccggtcgtaacccgggtaacgggaactaccgggttaacctggggtaaaacggtaacttttaaaacgggacttaacggttcggtaccgttacggaccaaccctacggtttaccgttagttccc

SEQ ID NO: 172576 - DNA, 742 bp, Homo sapiens
  misc_feature: GYAE6OF02G22P8.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaagtcacatccactcgccgggcagtcagacgtcgttggtagtagcttacacgtcgtaccgagcgagaacgaccgacggtacagtcctaccaaacgcctccgtacctaatacgtaaacggttataccggtccctttacccgtacgttaccccttttcccgtaccggttacccgggggttccccctacgggtacggtttaccgtaacgggtccgggtacgtaagggtggtaacgttcggtacggggtaactaacgtacctttccaaccccgttaccacctaactaacctaacgtacgtaccccgtagggaaacgtccgtagaaaggtacgtcgacgtgtaacgtaacctttaattaaccgtggtactaacgttacagttaccttaacgttacctttaaaccgttactaaggtacttacgtacccttacggtttacccggaccgggttaagggaccgttacggtacgtaacggtaaggtaaactttaaaccgggagttaccggtacgtacggttccaccgtaacgtacgttccgttctttacccgg

SEQ ID NO: 172577 - DNA, 741 bp, Homo sapiens
  misc_feature: GYAE6OF02GISJB.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagacaaaactgacaaagtcaaggcaggaagatgttgccatcacaactcattgggtttctgctgctctgggttccagcctccgagggtnaaagttgtgctgactcagtctccagtactttcagtctgtgactaccgaaaaggtacgaaacgtccacactccacctgccgggccagtccagacggtcggttaggtagtacgtacttacacgtagtaccagtcaagaacggccaggtctaacgtcctaccaaagtcctccctatactacaagtatcgtccttaccccgtagtcccttcgtaccgtaccggggtcccctggtacgttacacggtcggcacggtgtacgtcgtacggggactaaccgtaactttaaccccgtactacccaacgttacgaaagtaccgtaccgttaggaaacgttccgtaagtaaacgtatcgggtacctagaacccgttaaactttacttacgtactaactacgttacgtaaaccgtaacggtttaaccttaccgtttaaaccgttacgtaaaccggtttagtaacccgttaacccggttccccgttaacggggtacccgtaaaccgggttaaccccggaaaccgttacccggttaaggggtaacgttaaaccgtttaaaacggttaaccggg

SEQ ID NO: 172578 - DNA, 856 bp, Homo sapiens
  misc_feature: GYAE6OF02H3ZRL.27.78.H01.1.454.CMB.1.raw
  modified_base (134)..(134): a, c, t, g, unknown or other
  misc_feature (134)..(134): n is a, c, g, or t
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcanaactcattgggtttcngctgctctggttccagcctccgagggtnaaattgtgtctgactcagtctccagtacttcgagtctgtgactaccgaaaggagaacgtacaaccactcaccgtacggccggtaccagtcaaggcgtacgttggtacgtacgtcgttaaccagttacggtaccagtaccgaagtaacgccgtaaggtactacgttaccgtaacgtaaacgccgttacgtactactaaccgtaaagttacgtccggttaccttacccggtacgtttaccccgtttcggtacccggtacccggggtttaccccgtacgggttaaccggttttacacgggttacggacggttaccgggttcgtaacgtttaaccgggcgggtaaccctaccgtttaaccgttttaaccccaccccgttacgaacccgttaataaccgtaaaccgttaggtaccccggtaaggtaaaccgtaccttaagggaaacttacggtacgtaaccttcggttaaaacccttaagtttttacgtacgtttaaccgtaccttaacggttaacctaacgggtttaacctttaaccccgtttactttaacccgttacgttaacgtaacggtttacccgttacccggttaaaccccggttccgggtaacccggtaaacgggttaacccgtaaacggttacccgggtttaaagggtaacccgttaaacgtttaaaacccgggg

SEQ ID NO: 172579 - DNA, 627 bp, Homo sapiens
  misc_feature: GYAE6OF02JPBIU.27.78.H01.1.454.CMB.1.raw
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (430)..(430): a, c, t, g, unknown or other
  misc_feature (430)..(430): n is a, c, g, or t
tcagagcgtcgtctcacgaccggtgctcgatttagtgtgagtagtttgggtttggggatgagcaaaaactgacaaagtcaaggcaggaagatgttgccatcacaactcattgggtttctgctgctctgggttcagcctccaggggtgaaattgtgctgactcagtcctccanactttcaggtcngtgactccaaaggagaaagtcacatcaccgtgccggcagtccagagtcggtttgacgtgcttacacgtgtaccagcaagaagccaggctagtcctaccaaacgtcctcctacactactaagtactcgtaccttccctacgttccttctcgtaccgggtcccctgtaacgttcgtagtggcgagtgatcgtacggactactcttaccacctacgaccatacgtaactacgccgtagagctagaacgngtacgtacacgtaacctattacttacgttcgtactaacctacaagttaccttaacttaccttaaccttacgtaagtcctaaactcccggttaaccttcccggaaacgtaaaccgcgtaactccgtaaggacgttaaacgttaacgtacgtagtacggtaccttcggactaccttaacgttcgttccgtagttacccg

SEQ ID NO: 172580 - DNA, 803 bp, Homo sapiens
  misc_feature: GYAE6OF02GC39F.27.78.H01.1.454.CMB.1.raw
  modified_base (277)..(277): a, c, t, g, unknown or other
  misc_feature (277)..(277): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagtactttcagtctgtcgactaccgaaaggagaaagtcaccatccaccgtcggccgggcctagtcacggagtcgtttggtagtacgtccttaacacgtcggtaaccncgaccgaaggaacgaccgaggtcctaaggtccctaccgaaacgtccttccctacctaatactaaggttactcgtcccttccctacgttccttacgtccggtaccggggttcccctcggtacggttcgaggtcggtacgtaggtcggtattccggtacgggaaccctacttaacgttttaccccaaccccgttaccaaccctaacttaccgtaaacgttcggtacccggtaacgggaacgtcgtaaggaaacgtacgttacggtaccgttcggtaaccccttaaagttttactttaacgttcgtacgttaactaccgtaacgttaacgttttaaccctttaacccgtttaaccgtacgtaagttaccgttaccgttccccgtttaacccggttaaccgggtacccggtaaacgggtacccgaacgggttaccgtaacggggttaaattaaaacccgggttttaaacggaaccgtttagggcgttaccgtaccgtaacccgtaaccttcgtttacctagtttaccccg

SEQ ID NO: 172581 - DNA, 732 bp, Homo sapiens
  misc_feature: GYAE6OF02IMFP0.27.78.H01.1.454.CMB.1.raw
  modified_base (181)..(181): a, c, t, g, unknown or other
  misc_feature (181)..(181): n is a, c, g, or t
  modified_base (540)..(540): a, c, t, g, unknown or other
  misc_feature (540)..(540): n is a, c, g, or t
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgcttctgggttccagcctcgaggggtnaaattgtcgctgactcagtcctaccagtactttcagttctgtcgacctacgaaaggagtaaactccaccatccaccgtcggcccgggaccagtcagacgtcggttaggtacgtacgtacgttacgacgtcggtaaccacgtcaacggaacgccgtaggtcgtacgtcctaccgaaacgtcctcctacactacgtaaggttactcgttacccttaccgtaccgttcccttaccgtccggtacccgggttcccctggtacggttcgacgtggtctaggtcggtactcgtcgggtaaccacgtttaccttcccgacccttacacctaataccgtagtaccgacgttaggaactcgaggtaancgtcacgtacgtacttaaccgttacttacgtcgtacgtaacttccggtaagttaaccgtttaccttaacccgttaccgtaaccgttaacgggtcttaacccgttacccggtaacccgtttaaccgggaaccggtaaccgggtacccgtaacggtacccgggttaagtaaacccggttagttaaaccccgggg

SEQ ID NO: 172582 - DNA, 738 bp, Homo sapiens
  misc_feature: GYAE6OF02IMD9J.27.78.H01.1.454.CMB.1.raw
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccagggtgaaattgtgctgactcagtctccagtactttcagtctgtgactaccgaaaaggagaaacgtcaaccatccacctgccgggccagtcagagtcgttggtagtagcttaacacgtggtaccagacagaacgccgaggtacacgtctccaaaagtcctacctactatacaagtatcgtccttacccgattcccttctacgtacgggtcccctcgtaggttacaggtcgcgtagtgatcgtagggacctaacgtctttaccacccgtaccaaccgtactacaaacgttacgtaccgtacgggtaacgaccgtaagtaaacgtacgttacgccgtaggtaaccttaaaccgtttaactttaacgttccggtttaacctaacgttacgtaaagttaaccgtttaaaccctttaaccgttttaaccccttaagttaaacggttaacgttaaccttacccgttaacccggtttacccgggtaaccgaaaacgggtaccgtaccgtaaccggtaagggtaaccgtaaacgtttaaaaccggacgttaggtacgtacgttacgaacccgttaccgaaccgtttcgttccgttacctttacccg

SEQ ID NO: 172583 - DNA, 702 bp, Homo sapiens
  misc_feature: GYAE6OF02HIO66.27.78.H01.1.454.CMB.1.raw
  modified_base (295)..(295): a, c, t, g, unknown or other
  misc_feature (295)..(295): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaaggagaaagtcaaccatccaccgtgccgggccagtcagaggcgttggtagtagcttacacgtggtaccagcagaagccaggtcagtctaccaaagctcctnatacaagtatcgccttcccgagttcccttcgtaccgtacgggggttcccccctcggtacgggtttccaaggttcgggccgaaggttcggggtaacttcggtagggggaacctaaccgtacgtttttaccaccccctttccgaaccctaactacctaaacgtacgtacccgtaggaaacggtcctaaggaaacggtacgtagtccgtacggaccttaaacctttaacgtttaccgttagttaccgtaacttacgaacgtaacgttaacctttaacctttaacctacgtaagtacgtactaccgtaccgttaccggacgtaacggaccgtaacgtacggtagtaacgtaacgtaaccgtacgttaggtccgacgtccgtaccaccttacgttctaccgttagtaccccg

SEQ ID NO: 172584 - DNA, 714 bp, Homo sapiens
  misc_feature: GYAE6OF02HPSIQ.27.78.H01.1.454.CMB.1.raw
  modified_base (213)..(213): a, c, t, g, unknown or other
  misc_feature (213)..(213): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccgaggggtgaaattcgtgctgactcagtctccagtactttcagtctgtgactacgaaaggagaaagtcaaccntaccaccgtggcccgggactagtacgagacggtcggtttggtaagtagcctttaacaccgttcgggtaaccgagaccgaaggaaaccggtcctaagggttcacggtacccgttaccgaaaacgtccttccctacgaaccttacgtaaacgtagttccgtacccttccccgtaagttcccttccgtacggtacccggggttcccctcggttaggttacaggtcggtacaaggtcggtataccggttgggaacctacgttacttcccaccgtaccactacgtacaacgacgtccgaggtaacgctaagaagtgtacggtactggaaccttaacctttagtaaccgtcgtactacgtacaacgtataaccgttactttacctacgagtgacttccgacttaccggacgaaacggtacgaacgtaccgtagtaagtaaccttaaccgaattcggtaacggccgttacggacccgtaacctacggttaccttacgttaccttaccg

SEQ ID NO: 172585 - DNA, 625 bp, Homo sapiens
  misc_feature: GYAE6OF02I99J6.27.78.H01.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtctccagtactttnagtctgtgactcaaagganaaagtcacatcacctggccggcagtcagagcgttggagtagtcttacactggtaccagcagaacgcaggtcacgtcacaaagctcctcatacaagtatgccttccagttccttctcgacgggtccctgacggttcaggtgcgaggtggatgtaggactactactttccaaccctacacctaatccaatacgcctaagggaactacgtaagaagtatagtactagaaccttaaactttaattaaccgttgtactaacgttacaagtacgttaaacctttacctttaacctagtaacgttgtaaccttcctaaccgttaccggaacgtaacggggaaccacggaacgttacggaagtaaacgttaaaccgtaagttacggtagggtacctacgggtaccctaaccgtacgtttccgttacgttaccg

SEQ ID NO: 172586 - DNA, 667 bp, Homo sapiens
  misc_feature: GYAE6OF02JLZOX.27.78.H01.1.454.CMB.1.raw
  modified_base (146)..(146): a, c, t, g, unknown or other
  misc_feature (146)..(146): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (543)..(543): a, c, t, g, unknown or other
  misc_feature (543)..(543): n is a, c, g, or t
tcagagcgtcgtctcacgaccggtgctcgatttagtgtgagtagtttgggtttgggggatgagcaaaactgacaagtcaaggcaggaagatgtgccatcacaactcattgggttctgctgctctgggttccagcctccgaggggtnaaattgtgctgactcagtctcagtacctttngtcngtgactccgaaagganaaacgtccaccatccaccgtgccgggctagtcagagcgttggactagtccttaacgactggtacccagcgtaagacgccgtaaggtcacgtctacccaaagcctactcgatactaagtatcgccttccgtactccttcgtcgtacgggtccctgtacggttacaggtcggactccggtaggtaacgtcgtcgggaaactacttacgttaacccaccccgttacaaactcgtaacaacgttacggccgtaaggaagtccgtaagaaacgtgttacgactcggtaactaccgtttaataccggttnttaaccgngtaaccctagtaccgttaacttacgtaccgttanagttcgaacgttcgtaacccgttcggaccgtaaacgctaccgacgttagtaacgtaaacgtaacggaacgttaggaccgtaccttacggaccctaacctttcggtacgttcgttccgttaaccg

SEQ ID NO: 172587 - DNA, 654 bp, Homo sapiens
  misc_feature: GYAE6OF02JDMZD.27.78.H01.1.454.CMB.1.raw
  modified_base (175)..(175): a, c, t, g, unknown or other
  misc_feature (175)..(175): n is a, c, g, or t
  modified_base (364)..(364): a, c, t, g, unknown or other
  misc_feature (364)..(364): n is a, c, g, or t
tcagagcgtcgtctcacgaccggtgctcgatttagtgtgagtagtttgggttggggatgagcaaaactgacaagtcaaggcaggaagatgttgccatcacaactcattgggtttctgctgctctgggttccagcctccgaggggtgaaattgtgctgactcagtctcagactttnagtctgtgactacgaaaggagaaacgtcaccactcacccgtggaccgggtccagtcagagtcggttaggtagtagcttaacacgtcggaaccagacagaagccgaggtcagtctaccaaagctcctcatacaagtatcgtccttaccacgtccttacgtccgaccggggtcccctacggtaggttacgngtggcgtaggtagtctcggtacggacctacgtacttaccacctccaacctactacgtaactacgcgtaggaacgtcgagtaagactcgtcgaactacgtaaccttaagttactacgttctagttacgaacgttaacgttaccctttaacttaaccgtactaacgtcgtaactaccgttaccgttacggaacccggtaacgggaccgtaaccgtacggtacggaaagttaaccgtaaaccggtattaggtacgtacggtactacccgaacttcgtcgttactaccttaccg

SEQ ID NO: 172588 - DNA, 653 bp, Homo sapiens
  misc_feature: GYAE6OF02HIJ9T.27.78.H01.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtctccagtactttcagtctgtgactccaaagganaaagtcaccatccacctgccgggccagtcagagcgtcggtagtagcttacactggtaccagcagaagccaggtcagtctccaaagctcctcatcaagtatgcttcccagtccttctcgcggggtcccctcgagttcagtcggcacgtgggactcgtcgggacacgtacgtttccacccgtcacctatccaaatacgtacctagggaacgtcctaggaaagacgttacgctaggacctaaaccgttttactttaaccgttagttaccgaactacgtaacgtaacgttaacctttaccttttaacccttacgtaaagtttacggtaacttaccgtaacccgtttaccgggaccgtaaacggggacctaaccggtacgtaacgggtaagtaaacgttaaacgaacgttcggtacggtaccgtacgtaccaacctacgttacttcgttccctttaaccg

SEQ ID NO: 172589 - DNA, 838 bp, Homo sapiens
  misc_feature: GYAE6OF02IWB56.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtggttccagcctccgagggtnaaattgtgctgactcagtctccagtactttcagttctgtgacctaccgaaaaggagaaaacgtccaaccgtactaccgaaccgtcggacccgggaccaggtaccgaggtacggtccggtttagggtaagttagtaccgtttaaccaccgttacggttaacccaagaccgaaacggaaacggccccgtaagggttaccacggttacccgttaacccgaaaacggtcccgtttaccccgtactaaacgtaaccgtaaagtttacgtccggtaccctttaccccgtaacggtttccccttacccgttaccgggtacccgggggttacccccctttcgggttaacggtttacccgttaagggtccgtacgtaacgggttcggtaccgtttacggtacggggtaacctaaccgttacgtttaccccgacccttaccgaacccttataaccgtaaacggttacccgtcgttaacgggaaccgttcgtaacggaaacgttcgtacgtacacgtaaccttaaacgtttacttaacgttcgtaccgtacttacgtaacgtaacgtttaccttaaccttttaccgacgttaacgtctaaccgttaccgtaacgttaccggaccgtaacggacctaacggtaacgtaacggtaacgtaaccgttaaacgg

SEQ ID NO: 172590 - DNA, 623 bp, Homo sapiens
  misc_feature: GYAE6OF02GOEQQ.27.78.H01.1.454.CMB.1.raw
  modified_base (175)..(175): a, c, t, g, unknown or other
  misc_feature (175)..(175): n is a, c, g, or t
  modified_base (224)..(224): a, c, t, g, unknown or other
  misc_feature (224)..(224): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggtccagcctcagggtnaattgtgctgactcagtctccagtctttcagtctgtgactccaaagganaacgtcaccatccacctgccggccagtccagagcgttggtagtagcttacacgtggtaccagcagaagccaggtcacgtctaccaaagctccgtcatcgaagtactgaccttcccaagttcccttactccgtacgggttcccctggtacgttcagtcgcaggtgactcgtagggacctactactttccaccccgtcacctataccgaatacgtcccgttaggaacgtcgtagaaagacttacggcgtacgtaacctaacttttaacgttaccgttgtaaccctataacgtacgtaacgtacctttaacgtttaccctacttaaggtctacgttacctaccgttacggtaacccgaacgggtcctaaccggtacgtacggtaacgtaacgttaaaaccgg

SEQ ID NO: 172591 - DNA, 785 bp, Homo sapiens
  misc_feature: GYAE6OF02HIY0B.27.78.H01.1.454.CMB.1.raw
  modified_base (765)..(765): a, c, t, g, unknown or other
  misc_feature (765)..(765): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgagggtgaaattgtgctgactcagtctccagtactttcagtctgtgactccgaaaaggagaaagtcaccatcacctgccggacagtcagagtcggttggtatagcttacacgttggtaccagcaagaacgaccgtaggtcaaggtacctaccaaaagcctcctactaatacaagttacgtcgtaccttacccgattcccgtttaccgtacggtaccgggggttacccccctcggtaacggtttccgaacgggttacggactaagggttcggaagttccgtacggggtaacctaacgttaacttttacccgaaccccttccgaaacctaacttaccgaaaacgttacgtacccgttacgggaacgtaccgtaacggaaacgttaagttacgtaccttacggtaaccttaaaccttttaacggttaaccgttgtaccttaacgtaaccgttaaggtaaaccggtttaactttaacccgttttaacccgtacgtaaagttaccgaacgtttaacccgtaccgttaacccgggaacccgtaaagggaacccgtacggtaacttacgggaaacttaaacgtttaaaccgaacgttaggtaccgggttctaacgggaccctaaaccgtnttacccttaggtttaacccc

SEQ ID NO: 172592 - DNA, 837 bp, Homo sapiens
  misc_feature: GYAE6OF02IQJV6.27.78.H01.1.454.CMB.1.raw
  modified_base (150)..(150): a, c, t, g, unknown or other
  misc_feature (150)..(150): n is a, c, g, or t
  modified_base (182)..(182): a, c, t, g, unknown or other
  misc_feature (182)..(182): n is a, c, g, or t
  modified_base (388)..(388): a, c, t, g, unknown or other
  misc_feature (388)..(388): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaattgtgctgactcagttctccagtacctttngttctagtgactaccgaaaaggacgtaaagtccaacctatccaccgtggacccgggcacgtccgaagtaggtcggtttagggtacgtacgtcttaaccgacggttacggtaaccaggaccgaaggaaacggcccgtaagggtacctacggtcccttacccgaaaaggtccctaccccgtttacgaacgttacctaaaacgggtttntcccggtaccccttttaccccgaacggttttccccctttcgttaccgggtacccgggggttaaccccctttcggtagggtttccgaaggtcggaccgtagggttacggtacgttccggtaggggtaacctacgttaccgttttcccgaaccctacggaaacccttataccgtaaagttaccgtacggtacgggtaactcgtaaggtaacgttagtacgtacgtacgttaaaccttaacgtttactacgtttacgtacttataacgtactttaaccgttaactttaaccgttttaccgtacgttaaacggtcttaccgttacccgttaaccggtccggtaaaccggtaacggtaaccgacggtaaccgttagggtaaaccgttaacgttaaaccggttagtacggttacgaccgttaccgaccgtacgtacttacgttaccgtttacccg

SEQ ID NO: 172593 - DNA, 692 bp, Homo sapiens
  misc_feature: GYAE6OF02GFZVO.27.78.H01.1.454.CMB.1.raw
  modified_base (146)..(146): a, c, t, g, unknown or other
  misc_feature (146)..(146): n is a, c, g, or t
  modified_base (228)..(228): a, c, t, g, unknown or other
  misc_feature (228)..(228): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtgactcgaaaggagaagtcaccatcacctgcccgggccagtcagngcgttggtagtgcttacactggtaccagcagaacgccgaggtcagtctaccgaaacgctcctacatacaagtatcgtccttccctcgtccttctccgacgggtcccctggtacggttcgaggtcggcgtaggtcggtacgtcgtacgggacctacgttactttacccgtaacccctacctaaccctacgttaccaacgtaaccgtcccgtaaggaacgtccgtaaggaaacgtagtcgactcgttaaccttaaacgtttacttacgttacgtactaactaccgtaagtaacgtttaacccgtttaaccgttttaaccgtaccgtaagttacgttaccgttacccgttaccgttacccggtaccggaaagggtaacccgaacggtacgtacgggtaacttaaacgttaacggtaacggttcggtaaccggtctacggaccttaccgtatccgttacgtccttacc

SEQ ID NO: 172594 - DNA, 922 bp, Homo sapiens
  misc_feature: GYAE6OF02JNM2C.27.78.H01.1.454.CMB.1.raw
tcagagcgtcgtctcacgaccggtgctcgatttagtgtgagtagtttgggtttggggggcgatgagcaaaactgacaagtcaaggcaggaagatgttgccatcacaactcattgggtttctgctgctctgggttccagcctccaggggtgaattgtgctgactcagtctccagactttcagtctgtgactcaaaggagaagtcacactcacctgcccggccagtcagagtcgttggtagtgctacacgtcgtacagacgagaacgccgagtcgagtcctacgaaacgccttacctacgataacctaagttacgtccgtccgttacccctacggtttccttttaccgtaccggtacccgggggttccccccttaccggggtaaacggtttcccgtacggggttcggtaccggtaacgggtttaggggtacccggtttacgggtacccgggggtaaccctaaaccgttttaccgttttaaccccccgaaccccccgttttaaacccacccccggttaaaattttaaccccggaaaaaacccgttacccggggttaccccgggtttaaacggggtaaacggttacccgttaaacggggtaaaacgggtaccgtttaagggtacccgttaaacgggttaccctttaaaaccctttttcgtttaaccgtttaccgggttaacttaaccggttacgtaaaacggtaccgttttaacccgttttaaaccctttaacctttacccgttaaggggttaaccgtaaccgtttacccggtttaacccggttaccgggttaaacccgggaaccgggtaaacccgaacgggttaaccggtaggggtaaaacgttaaaccgtttaaaacggttaaccgggtcggttaccggggtactacccgggtacctaaccgtttccgttaccgtcggttaccg

SEQ ID NO: 172595 - DNA, 606 bp, Homo sapiens
  misc_feature: GYAE6OF02GUYX6.27.78.H01.1.454.CMB.1.raw
  modified_base (179)..(179): a, c, t, g, unknown or other
  misc_feature (179)..(179): n is a, c, g, or t
  modified_base (230)..(230): a, c, t, g, unknown or other
  misc_feature (230)..(230): n is a, c, g, or t
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccaaaagganaaagtcaccatccacctggccgggccagtcagagcgttgggtagtagtccttaacacttgggtaacccaggcaggaacgcccaaggtcagtcctacgaaagctcctcattcaaagtatcgccttcccagttcccttcgtcgaccggggttcccctaggtacggttccaggtcggcctagggttcggacttcgnggggtaccacgtacttttccaaccctcaccgtactacaaatcgaccctggaacncgtagaangtgctcgaacaacgtttatactgtactagacagtacgttaccttactttacctagaacgttcatacccgtaccgttccggacgtaacgggaccacgtaccgtaggaacgtaattaaaccgg

SEQ ID NO: 172596 - DNA, 798 bp, Homo sapiens
  misc_feature: GYAE6OF02F1EU2.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtntaattgtgctgactcgagtctccagtactttcagttctgtcgtactaccgaaaaggacgaaacgtccaacctatccaccgtcggaccggccagttacacggtaagtcggtttaggtacgttacgtcgttaccacgttcggtaccagacaaggaacgaccgtaggtaccacgttaccctaaccaaaccggtccttaccctacaacgttaccgtaaacggttactccgtacccctttacccgtaaccgtttcccgttccgttaccgggtacccgggttccccgttacggtacggtttacgacgggttcggtaccgtaaggttcggtaacgtccggtaggggtaacctaacgtttacctttacccgtaccccgttaccaaccgttacctaacgtaacgtacggtaccgtaacgggtaacgtacgtaacgaacgtagtaccgtacgtacgttaacgtaaccgtttagttaccgttacgtactacggttaaccacggttaacttaaccgtttaaccgtttaccgtaacgtaaccgtacggttaacctaccggttacccggtaaccggtaaccggtaccgtaaccgtaaccggtacggtaacggttaacgtaccggttaaaccgg

SEQ ID NO: 172597 - DNA, 574 bp, Homo sapiens
  misc_feature: GYAE6OF02FULHE.27.78.H01.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtnaattgtgctgactcagtcctccagactttcagtctgtgactccaaaggnaaagtcaccagtcacctgaccgggccagtcagagcgttggtagtagcttacactggtaccagcagaagccaggtcagtctccaaagctcctcatcaagtatgcttcccagtccttctcacggggtcccctcggagttcagtggcagtggactcgtagggacanatttcaaccctcacatcaatgacctggaanctgaagtgtagcgtagctaacttattactgtactagtcaggtattacttacctttaaccncgtaagtgtaactctaccgtttaccggaccaacggggtaccacggtactacggacggtaattaaaccggaaccttggacggaccgttacggcctaaccggtaactaccgtttagtccgtttaacccg

SEQ ID NO: 172598 - DNA, 699 bp, Homo sapiens
  misc_feature: GYAE6OF02GDTNJ.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtcgactccaaaggagaaagtcaaccatccacctcggccgggccagtcagagcgttggtagtagcttacacgtggtaccagcaagaacgccaggtcagtcctaccaaagctcctcatacaagtatcgtccttccctacgttcctttctcgtaccggggttcccctcggtacggttacgacggtggacgtaggtggtacttcggtacgggtaccaacctactttacccaaccctcaaccctataccgtaaactacggaccgttaggaacgtcgtagaagtacgtgtaccgtacgtaccttaactttaactttaccgttacgttacttactaacgtaacggttaactttaacccgtttaacctttaccttaccgtaacgtttacggtaaccttacccgttaaccccggtttcccggaaccgggtaaaccgggtaccgtaaccggttacgggttaacggtaacggttaaacggtttaaaacccggg

SEQ ID NO: 172599 - DNA, 629 bp, Homo sapiens
  misc_feature: GYAE6OF02IW1ZF.27.78.H01.1.454.CMB.1.raw
  modified_base (285)..(285): a, c, t, g, unknown or other
  misc_feature (285)..(285): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaccatcacctgccggcagtcagagcgttggtagtagcttacacgtggtaccagcagaagccaggtcagtctcaagctcctnatcaagtatgcttccagtcctctcgacgggtccctgaggttcagtcggcagtggatcgtgggactactatttccaccctcaccatccaatacgccgtaggaacgcgtagaagactgctgacctaaactttattactcgttactatacgtaacgtaacgtttaaccttaccgttttaaccctacgtaaacgttcgtaacttacccgttaaccgtttacccgggaaccgtaacggggtaacccgtaccggtaacgttaacgggaacggttaaaacgtttaaaacccgggtaacgttcgggttaccggacgttaccgaccgtaaccctagttcccgtacgtttaccc

SEQ ID NO: 172600 - DNA, 593 bp, Homo sapiens
  misc_feature: GYAE6OF02IXVXB.27.78.H01.1.454.CMB.1.raw
  modified_base (416)..(416): a, c, t, g, unknown or other
  misc_feature (416)..(416): n is a, c, g, or t
  modified_base (479)..(479): a, c, t, g, unknown or other
  misc_feature (479)..(479): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagactttcagtctgtgactccaaaggagaaagtcacatcacctgccgggccagtcagagcgttggtagtagcttacactggtaccagcagaagccaggtcagtctaccaaagcctcctcatcaagtatgccttccagttccttctcgacggggtcccctcgaggttcaggtggcagtggtactcgtgggacacgtactttccaccctacaccatcaactacgccgtaggaacgctaggaagtntgctagactaacttattacgtgtctatactagtacttaccttaaccgtttacctacgaagttnacttactacccgttacggaccgtaagggaccacgtacgtagggtaacgtaacgttaaaaccggacgttacggtacggacttacggaccctaaccgtacttccgttcgtttaccc

SEQ ID NO: 172601 - DNA, 835 bp, Homo sapiens
  misc_feature: GYAE6OF02GUTQX.27.78.H01.1.454.CMB.1.raw
  modified_base (229)..(229): a, c, t, g, unknown or other
  misc_feature (229)..(229): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgcttcgtgggttccagcctccgaggggtagtaaatttgtgctgactcagttcctacctagtactttcagtctgtanacctacgaaaggagaaacgtccaaccagtccaccgtcggccggccagtacgaggacgtcgttggtagtacgtccttaacgacgttacggtaccaacgtacgaaggtaacgccgaggtacctacgtaccgtaaccaaacggtcctacccgtactaactacgtaaaggttactacgtccctttacccgtactttcccgttaccgttacccggtacccggggtccccgttacgggttacggttaccgtagggtccggtacgtagggttacggtacgttacgggtaacgggtacctaaccgtttacgtttacccccgaccccttaacgaacccttaactaaacccgttaacgggtaacccgccggttaaggaacgtaccggttaagaaacggttacgttcgtaacttcgtaaaccgtttaaaccttttacgtaccttacgttaccttaacgttaaccggtaaacggttaaaccctttaacggtttaaccttttacccgtaagtaaaccggtttctaaaccgtttcccgttaaacccggttaccggaaaccggtaacgggtaccctaaccgggttaaccgtaagggttaacccgttaaaaccggttaaccg

SEQ ID NO: 172602 - DNA, 611 bp, Homo sapiens
  misc_feature: GYAE6OF02F5QMK.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctggccgggccagtcagagcgttggtagtagccttacactggtaccagcagaagcaggtcagtctaccaaagcctcctacatcaagtatcgtccttcccgtacgttcccttcgtccgtacggggttccccctcggtacggttctaggtcggacaggtggagttcgtagggacactatttccaccctcacctatacaactcgccgtaggaacgtctaggaagacgtgtcgtgtacctaactttacttacttgtactatacgagtacgttaacctttaactttacctacgtaacgtgtaacttccgtaacccttacgggaccgtaacggacgacgtagtacggaagtaacgttaacgtaacgtagtacggtactcgaccactacttaccgtacgttacc

SEQ ID NO: 172603 - DNA, 668 bp, Homo sapiens
  misc_feature: GYAE6OF02G6DCY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatacacctgccgggccagtcagagcgttggtagtagcttacacgtggtaccagcagagccgaggtcagtctaccaaagctcctcactacaagtatcgactccctagtccttcgtccgtacgggtcccctggtacggtcgaggtgcagtggtactcgtgggactacgtacgtttaccaccctaccgaacctactacaaacgtcgaccgttagggaacgtccgtaaggtaagtacgttcggacgttcgaaccgtaaactttacttacgttacttacgtaacttaccgaagttaaccgttactttaacctttacccttacgtaaacgttcgtacttacccgtacccgtttaccggaaccggtaaacgggacctacggtacgtaacgggtaaggtaaaccgttaaacggtaacgttaggtacgtacgttaccgaccgtaccgtaacttcggtttacctactttaccc

SEQ ID NO: 172604 - DNA, 562 bp, Homo sapiens
  misc_feature: GYAE6OF02G92IC.27.78.H01.1.454.CMB.1.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaagtcaccatcacctgccgggccagtcagagcgttggtatagcttacactggtaccagcagaacgccaggtcagtctccaaagctcctcatcaagtatgccttcccagtccttctcgacggggtcccctcgaggttcagtcggcngtgatctgggacacagttcacccttcaccatcaatacgcctaggaacgctagaacgatcgctgctaacttattactgtcatcagacgttacttactttacctcaagttgacttacctaccttccggacctaacggggacctacggaactcgggtaataacgttaaacgtaaacgttacggtggtacctacggaccctaacctactccgtgtttaccc

SEQ ID NO: 172605 - DNA, 596 bp, Homo sapiens
  misc_feature: GYAE6OF02JCJ78.27.78.H01.1.454.CMB.1.raw
  modified_base (145)..(145): a, c, t, g, unknown or other
  misc_feature (145)..(145): n is a, c, g, or t
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
tcagagcgtcgtctcacgaccggtgctcgatttagtgtgagtagtttgggtttggggatgagcaaaactgacaagtcaaggcaggaagatgttgccatcacaactcattgggttctgctgctctgggttccagcctccaggggtnaaattgtgctgactcagtctccagtactttcagtctgtgactaccaaaggagaaaagtcaaccgatcacctggccgggccagtcagacgtcggttggtagtagcttacacgtggtaccagcaagaaagccaggtcagtctaccaaagcctcctcatacaagtatgccttcccngtccttcgtcgacgggtcccctgacgtcagtgcagtggatcgngggacactactttccacctccaacgtactacaagttcgccgtaggaacgagtaaggaaagntggtacctagtactaacgttattaaccgtgtacctagtccaagttacgtaaccttactttaccacgtaagttcgactcctaaccgttccgaacgaacgtacacggtacagggaagtaacttaacggtacgtaggtacgacgtccgactaccgttaatcgttacgtccttaaccg

SEQ ID NO: 172606 - DNA, 527 bp, Homo sapiens
  misc_feature: GYAE6OF02F9YJS.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagaagccaggtcagtctccaaagctcctcatcaagtatgcttcccagtccttcgtcgacggggtcccctcggaggttcaggtggcaggtggatcgtgggacactatttccaccctcgaccatacaatacgccgtaggaacgtctagaagatgctgactaacttattacttgtcatcagtactacttacttaccatagtgactctacttcgacaaggacacgatggagtaattaacgagtgtagcgtcgacctacctatcttcgttctaccg

SEQ ID NO: 172607 - DNA, 749 bp, Homo sapiens
  misc_feature: GYAE6OF02J0566.27.78.H01.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (714)..(714): a, c, t, g, unknown or other
  misc_feature (714)..(714): n is a, c, g, or t
tcagagcgtcgtctcacgaccggtgctcgatttagtgtgagtagtttgggtttggggtagtgagcaaaactagacaagtcaaggcaggaagatgttgccatcacaactcattgggttctgctgctctgggttccagcctccaggggtgaaattgtgctagactcagtctccagactttcagtctgtgactaccaaagganaagtcacatcaccagccgggcagcagagcgttgtanacgnttacacgtggtaccagcagacgccnggtacagtctacaagcctacctnatacagtatcgtctacctacgtcctcgtccgacgggtcccctaggtacgttacacggtacggtcaggttacgacgtcgtacgggtacctattaccgttttacccaaccccgtcgtaaaccctacgttaaccctaaaagtcccgtaccggttaacggtaaccgtaccgtttaaaggaaccggtaagtcgttaccgtacgggttaaccttaaacttttaacgttaccgttacggtactaaacgttcccgtaaaggtaaccctttaaccggttttaaacccttttaacccgttaagtaacccggttagtaccggtacctttaacccggtaccccgggtaaaggtaaaccgggaccttaaccggaccgttaaggtaacccgtaaacggttaaccggtaataacgggttcggtaaccgttccgtaaacccncccgtttaagtccggtttaccttaccgttaacccg

SEQ ID NO: 172608 - DNA, 986 bp, Homo sapiens
  misc_feature: GYAE6OF02HV6MF.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgagggtgtaattgtgctgactcagtctccaagtctttcgagttcttgtcgactaaccgaaaaggagaaacgttcaaccactaccgacccgtcggacccgggacctaaggtaccgacggacggtaccggtttagggttaaggtaacgtacctttaaccgaaccgttacgggtaaccccgaggtaacccaaggtaaaccggtcccgtaacgggtacccgtaaccgttaccgtaaaccccgtaaaacggtccctttacccgttaccaaacgttaaaccgtaaacggttacgttaccgttccccgtttacccccggttacgtttacccccgttttaccgtacccggggttaacccgggggttacccccttacgggttacggggtttaaccgtaaggggttacgggtacccggttaagggttacgggtaccgtcggggttaaccgggtaccctaacgtttacccttttaacccccgtaaccccgttaccctaaccttaactaacccgtaaacgttacccgacccggttaagggtaaacccggtcgttaaacgggaaacgttacgttaggacccttaagttaaacccgttttaaaactttaaccgttttaacgtacgtttacccgtaacgtttaaccgtaaaacggttaaccgttttaaccctttaacccgttttaaacccgttaacggtaacgtttaaccgtaacccgttacccgttaaaccccggggtttaacccgggaaacccgggtaaaaccgggttaccgaaaccccggttaaacgggttaacggttaaacggttaaacccgtttaaaacccggg

SEQ ID NO: 172609 - DNA, 577 bp, Homo sapiens
  misc_feature: GYAE6OF02F26A0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgacctaccaaaggagaaagtcaccatcaccgtgccgggccagtcagagtcgttggtagtagcttacacgtggtaccagcgagaagccaggtcagtctaccaaagcctcctcatcaagtatcgccttcccagtccttctcgtacggggtcccctcggtacggttcaggtcggcaggtggactcgtgggacactattccaccctcacatcaatcgcgagaagctagaagtatgctcgactaacttattacgttgtactacgtcaagtacttaacttacctttacctagaacgttcgtacttactaccgttaccgacgaagggaccacggtacgtaggaagtaactaaacgtaacgttggtacgtcgtacgtaccaacctatccgtacgttctacc

SEQ ID NO: 172610 - DNA, 708 bp, Homo sapiens
  misc_feature: GYAE6OF02I7O59.27.78.H01.1.454.CMB.1.raw
  modified_base (150)..(150): a, c, t, g, unknown or other
  misc_feature (150)..(150): n is a, c, g, or t
  modified_base (229)..(229): a, c, t, g, unknown or other
  misc_feature (229)..(229): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctccaggggtgaaattgtgctgactcagtctccagactttcagtctgtgactcgaaagganaaagtcaccatccactgccggcagtcagagtcgttggtaatagaccttacacgtaggtaccagcaagaacgccaggtctacgtcgtaccaaagcctaccgtacatacaagtactcgccttacccgattccttactcgacggggtccctagaggtttcaaggttcgacctaggtcgacgttacgtacgggacctaaccgtatttacccgaaccccgtacaaccgtaatacccgtaaagttaccgtaccgtaggtaacgtaccgttacgtaaacgtnttaccggacttaccggaccttaaaccgtttacttaaccgttgttaaccaactttacccgaaaggttaaccgtttaacctttaacccgttttaccgtaaccgttaacgttacggtaaccttaccgttaacccggtttacccggaaccgttaacccggggactaaaccggtaaccgttaacgggtaacgtaaccgtttaaaaccgg

SEQ ID NO: 172611 - DNA, 752 bp, Homo sapiens
  misc_feature: GYAE6OF02HSUAB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaatttgtgctgactcagtcctcagtactttcagtctgtgactaccaaaggacgaaagtccaaccacgtacctaccgtcggccgggccacgtcgaggagtcggttggtaacgtacgtcttacgtacgttcggaaccacggaccgaagaacggtaccgacggttacacgttcctaaccgaaacgtccttaccttacgaactactaagtactcgtaccttccgtacgttccttcgtccgtaccgggtacccctggtacggttccgtaggtggaccgtaggtcgggtacttcggtacggtactaaccttacgtttaccctacccctaccaacctactactaaacggtaccgaccgtagggaacgtacgtaaggtaagtacgtgtcgtaacctacgtttaaccttacttagttacgttactacgtagtaacgtactttaccgtttacctttaactacgtaacgtacgtacttaccggtaccgttaccggaacggtaaacgggaacccgtaccggtacgttaagggaaaccgtttaaacgttaacggaacggttaggtaccgtacggtaaccttacgtacgttacgttaccggttttctaccgtttccg

SEQ ID NO: 172612 - DNA, 833 bp, Homo sapiens
  misc_feature: GYAE6OF02G2T6D.27.78.H01.1.454.CMB.1.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaacgtcaccatcacctcgccgggccagtcagagcgttaggagtagcttacncgtggtaccagcaagagccaggtcacgtctaccaagtcctcctnactacaaagtntcgtaccttccctacgtccctttcgtcggtaccggggttcccctggtacggttcgacggtcggctacggtgggtaacttcgggtacgggaacctaccgttactttacccgtacccctaccgtaaccctaactcgtaaaacgtcggaccggtaggaacgtccgaaggaacgtacggtccgacgttacggtaaccttaaacgttttacttaaccgttacgttaccgtaacttaacgtaacggttaaactttaaccgtttaacccgttttaaacccgttaacgtaaacggtttaacccgttaaccgttacccggttaaccccgtttaacccggggtaaaccccggtaaacccgggggtaaccgttaaccggggtaaccgggtttaaacggggtaaaccgggttaaaaacccggttttaaaacccgggtaacggtttacccggggtttaacgggtaccgttacccgggtaaccccttaaaccggttaccccggttaacgttttaccgggttttaacccctttaaaccccgg

SEQ ID NO: 172613 - DNA, 743 bp, Homo sapiens
  misc_feature: GYAE6OF02HKOUX.27.78.H01.1.454.CMB.1.raw
  modified_base (193)..(193): a, c, t, g, unknown or other
  misc_feature (193)..(193): n is a, c, g, or t
tcagagcgtcgtctcacgaccggtgctcgatttagtgtgagtagtttgggttggggatgagcaaaactgacaagtcaaggcaggaagatgttgccatcacaactcattgggtttctgctgctctgggttccagcctccaggggtgaattgtgctgactcagtctccagtactttcagtctgtgactcaaaggngaaacgtcaccatccacctgccggcagtcagagcgttggagtagcttacgactggtaccagcgagaacgcgaggtcaggtcctaccgaaacgtcctacctcactacaaggttactcgtcttccccgtaattcccgttacgtaccggtaccggggggtttcccccttacgggtacgggtttacccgtagggtcgggtacggtacggttcggaacggtttccggtacggggtaacctaccgtaactttttcccgaaccctacgtaaccctacgtaaccaacgtacggtaccgtacggaacgtcgtaacggaacgtacgttagaccgttacgaccgttaacttaacgttacgttacgttaccgtattaccgaagtaaccgtttaaccttaccgttttaacccgtagtaacgttacgtacttaaccgtacccgtttaacgggacccgtaacgggaccgtaaccgtacggtacggtaaccggttaacgttaaaccgtacggtacgtacggtacctcggtaccaccgttacgttacccgttcgtaccctttaccgg

SEQ ID NO: 172614 - DNA, 665 bp, Homo sapiens
  misc_feature: GYAE6OF02GUADK.27.78.H01.1.454.CMB.1.raw
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattggtgctgactcagtctccagactttcagtctgtgactaccaaaggagaaagtcaccatcaccgtgccggcagtcagagcgttggtatgcttanactggtaccngcagacgcaggtcagtctacaagctctcatacaagtactcgccttccagttaccttctccgtacggggtcccctaggtacggttcgaggtcggacgtaggttgggaattccggtagggaacctcgttacgtttacccaccccgtactacaacgttacgaaacgtcgtacccgtagggaacgtcgtaaggaacgtagtcgtcttacggtactaaactttacttacgttacgtcctataccgaagtacgtttaaccttacgtttaaccgagtaacgttgtacgtaaccctaccggttacggaccgtaaacgggacctaacggtaccgtaggtaacgtaacgttaaaaccggtacgttagggtaacgtaccgtacgttaccaaaccgttgttaaccgttcttaccgtttacccg

SEQ ID NO: 172615 - DNA, 542 bp, Homo sapiens
  misc_feature: GYAE6OF02FUBKT.27.78.H01.1.454.CMB.1.raw
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgcccgggccagtcagagcgttggtagtagctttacactggtaccagcagaagccaggtcagtctccaaagctcctcatcaagtatgcttcccagtccttctcaggggtcccctcgaggttcagtggcngtggatctggacacatttcaccctcaccatcaatacgctaggaagctgaangtgctgctaacttattactgtactatcctagacttactactttacctatagtacgactacctaccgttcggaccgtaagggaccacgtacgtgggacgtaagttaaaccgacgtggtcggacttacggactacccgtatcgtcgtcttacg

SEQ ID NO: 172616 - DNA, 869 bp, Homo sapiens
  misc_feature: GYAE6OF02JGXHR.27.78.H01.1.454.CMB.1.raw
  modified_base (250)..(250): a, c, t, g, unknown or other
  misc_feature (250)..(250): n is a, c, g, or t
tcagagcgtcgtctcacgaccggtgctcgatttagtgtgagtagtttgggtttggggtagtcttaaagaggttctttctctgggatgtggcatgagcaaaactgacaagtcaaggcaggaagatgttgccatcacaactcactttgggtttctgctgctcgtcgggttccacgcctccgaggggtagaattgtgctgactcagtctccagtctttcagttctgtgacctaccaaaggagtaacgtcaccntaccgacctcggaccgggaccaggtcaaggtagtacggttacggtagtaactccttaacgtctacggtaaccagacgaagacggccgtacggtacacggttacctaaccgaaagtcccctacttacgaacgtttaccgaaaacgttcgaccggtttccttaaccccgtacgtttacccccttacgtaccccggggttaaaccgggggttccccccttaggggttaacggttttccggaagggtacggtaccgttaacgggtcggggtactttacccgggtaaccgggtaaccgtttacccttaacgtttacccccgtacccctaaccctaacctaacgttaccgtaaacggttaccggtaccggtaaccgggaaacgttcggttaaacgtaacgggacttaacccgggtcttaaccggaaccgttttaaactttacccgtttaaaccggttcttaaccggtacttaacccgggttaaagtaaacccgttttacccttaaaccgtttaccgttaaccggttaaacggttctaaacccgtttaccctaaccccgggtttaccggaacccgtaaggggaaccctacgggtaacgttaacggtaacgttaaacgttaaaccgg

SEQ ID NO: 172617 - DNA, 671 bp, Homo sapiens
  misc_feature: GYAE6OF02F440T.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtcgactccaaaaggagaaagtccacatcacctcgccggccagtcagagtcgttggtagtagcttacacgtggtaccagcagaagccaggtcagtcctaccaaagtcctcctcatacaagtatcgccttcccagtccttctacgacggggttccctggaggttcaggtcgctaagtggtactcgtaggactacgtacttaccacccctacaacctatacaacgtacgccgttaggaacgtctaaggtaacgagtcgtaccgtagtaaccctaaacgtttacgtttaaccgttagttaccttaagttaaccgaaacggttaacgtttaaaccctttaaccttttacccgtaacgtaaacggttacgtaacttaccccgtaacccgtttaacccggaacccggtaaacgggtaccaaaccggtaaccgtacgggtaaacgtaacgtttaaaacccgg

SEQ ID NO: 172618 - DNA, 657 bp, Homo sapiens
  misc_feature: GYAE6OF02IVQT3.27.78.H01.1.454.CMB.1.raw
  modified_base (153)..(153): a, c, t, g, unknown or other
  misc_feature (153)..(153): n is a, c, g, or t
  modified_base (187)..(187): a, c, t, g, unknown or other
  misc_feature (187)..(187): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttcccagccctccgagggggtnaaattgtgctgactcagtctccagactttcagtntgtgactccaaaggagaaagtcaccatccaccgtcgccgggccagtcaggacgcgttggtatagccttacgactggtaccagcagagccaggtcngtcacaagctacncatcagtntcgcttcccagtccctcgtcgtcggggtcccctggtaggttccagtcggctaggtgattccggnggctaactctttccaacccncaaccgtactccgtaatacgtccgtaggtaacggctaacggaagagttacgcttacgaacccttaaacgttactttacgttaacgttacctagcgtaacggtacgtttaacccttaaccgtttacccgttactaaacggttacggtaacccttaccgtaacccggttaccccggtaacgtaaccggacggtactacgggttggtaaaccgttaacgttaaacgtacggtacggtcggtactcgacccacgtaccttcggttaccgttacc

SEQ ID NO: 172619 - DNA, 637 bp, Homo sapiens
  misc_feature: GYAE6OF02HK348.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacacgtggtaccagcagaagccaggtcagtctaccaaagctcctacatcaagtatcgccttcccagttccttcgtaccgtacggggtccccctacggtacggttcaggtcggacaggtcggtactcgtacgggactacgtactttaccaccccttacaacctactactaagtacgcctaggaacgtctaggaagactagactcgtactaacttattactagtcatcgagtacgttacttaaccgtttacctacgtaagtcgtacttccgtaaccgttaccggaccgtaagggaccaccggtaacgttacgggtaacggttaaacgtttaaaaccggaaacgttcggtacggtccgtacggaccctaaccgtacttccgttacgtttacccg

SEQ ID NO: 172620 - DNA, 619 bp, Homo sapiens
  misc_feature: GYAE6OF02G9SBN.27.78.H01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaagganaaaagtcaccatcacctgccgggccagtcagagcgttggtagtagcttacactggtaccagcagaagccaggtcagtctaccaaagcncctcatcaagtatgcttcccagtccttctcgacgggtccctgaggttcaggtgcagtgatctggacacacttcaccctacaccatcaatacgcctagggaaacgtctagaaagagtgccttagacctaaactttattaacgttgtacctatacaagtagttaaaccttacgttttaacccaactaagtacgtaacttaccctaaccggtttacggaacccaaaaggggtacccaacggtaccgtagggtaaacgtaaattaaaacccggtaaacgttggtaacggttacctacggaccctaaacctagtttacccgttacgtttaccttacccg

SEQ ID NO: 172621 - DNA, 640 bp, Homo sapiens
  misc_feature: GYAE6OF02HK24E.27.78.H01.1.454.CMB.1.raw
  modified_base (235)..(235): a, c, t, g, unknown or other
  misc_feature (235)..(235): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgacctaccgaaaggaagaaagtcaccatccacctggccggcagtcagngtcgttggtagtagcttacacgtgtaccagcagaagccaggtcagtctaccaaagcctcctcatacaagtatcgtccttaccctacgtcctttccgtcgtaccgggtttccccgtacggtacggttcgtaggtcggacgaggtcggtagtcgtaggactactacttcctaccctacacctataccgtaagtacgtccgtaggactacgtagaagtctgtctacgtaacttacttattacgtntacctaagtcgtaagtaccttaactttaccctttacgtacgtaagttactactaccgttacccggtacgtaaccgaacggaactacgaacgttaggaacgttaaacgtaaacgtacggttacggcgtaccgtacgacctaccgtacgttccgttacgttcccg

SEQ ID NO: 172622 - DNA, 756 bp, Homo sapiens
  misc_feature: GYAE6OF02HQKB1.27.78.H01.1.454.CMB.1.raw
  modified_base (146)..(146): a, c, t, g, unknown or other
  misc_feature (146)..(146): n is a, c, g, or t
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (744)..(744): a, c, t, g, unknown or other
  misc_feature (744)..(744): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtcctgtnacctacaaagganaacgtcaacatccacctcgccggctagtcagacgtcgttaggtagtagtcttacgacgttaggaccagtcaggaacgaccgaggtacacggttacctacctaaacgtcctacctacaacttaccgaaagttacgtcgtccttaccccgtacgtttccctttccgtacggtacccggggttcccccttaggtaccgggtttaccagggttccgggactacggttacggtactttccgggttaacggggaccctttaacgttacggttttaccccctaaccctccctaaaccctacgttaaccgtaaacttccgggtacccgttaacgggaacttaccgttaacggaaacgtacgttccgactaccggtaactaacgtttacgtacgttcttaacgacttacgacgttaacgttaacctttaacgttaccgtaacgttacgtaccgtaattcccgaaccgtttacggaacccgtaaggtaccacgtacgtaacggtaagtaaccggttaaacgtcgtaggtaccgataccgtacgcctagttccgtntaccgttacccg

SEQ ID NO: 172623 - DNA, 652 bp, Homo sapiens
  misc_feature: GYAE6OF02HH7HX.27.78.H01.1.454.CMB.1.raw
  modified_base (165)..(165): a, c, t, g, unknown or other
  misc_feature (165)..(165): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggtccancctcgaggggtgaattgtgctgactcagtcctccagtacttcagtctgtacgactaccgaaaggaagaaagtccaccaatccaccgtcggcccggaccagtcgagaggtcggtttaggtaagtacgtaccttaacacgtacggtacgagacgagaacgccgaggtctacgtacctaccaagtcctcctacatacaagtactcgtcctacctacgttccttcgtacgtaccgggtccctgtagttccagtgcaggtcggctcggtacgactactacttaccacctcactactacaactcgtaccgtaggacgtacgtaggaagtacgtgacttacgaactttaacttacgttacgtacgttactaactaggtactaaccgttaaccttacgttacccgttaagacgttacgaccgttaccttaacccggaccggtaaccgtaacggacccgtaaccggtacggttaacggtacgtaaccttaaaccgg

SEQ ID NO: 172624 - DNA, 723 bp, Homo sapiens
  misc_feature: GYAE6OF02IGFDL.27.78.H01.1.454.CMB.1.raw
  modified_base (207)..(207): a, c, t, g, unknown or other
  misc_feature (207)..(207): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactacaaaggagaaagtcacancactgccggcagtcagagtcgttggtagtagcttacacgtggtaccagcgagaacgaccaggtcacgtactaccaaagtccttcctacaattcaaagttactcgtaccttccctacgttcctttcgtaccgtccgggttcccctcggtacggtttcgaaggtcgcgtagtcggtaacgtcgtagggaaccactttacgtttacccaccgttaccaacccacttacgtaaaacgttcgtaaccgtagggtaagtaccggtagaaagtacgtgtaccgtacgtaactaacgtttaacttacgttactacgtaattaccgaggttaacgtttaaaccttacccgtttaacttacggaacttacgtaacgtttacccttaaacccgttccggtaaacccggaacggtaacccgtaacgtacggttaccgggtaaacgttaaaccggttaaaacgaccggttacggtacggttacgtacgaaccgttacccgtagttttacctccggttaacccttttccg

SEQ ID NO: 172625 - DNA, 667 bp, Homo sapiens
  misc_feature: GYAE6OF02JGLM4.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtacctttcagtcgtgtcgactaccaaaggagaaagtccaccatcaccccccgtgccggccagtcagagcgttaggtatagcttacacgtggtaccagcagaagccaggtcagtctaccaaagcctacctcgataccgaagttactcgtacctttaccccgagttccccttacgtaccgtaccgggggttccccctcggtaacggtttccaagggttcggacgtacggttacggacgttcggtaggggaacctaactacttttaccgaacccctcaacctactacgaaactacggcccgtaggaacgtctaaggaacgtacgtcgcgttacgactaaactttacttacgtactctactacgacgtaacgtaccttacctttaccgtacgtaagtacgtacttacctaccgttccggaaccgtaacgggtacaaccggtacgtacggtacgtaacgttaaaccgg

SEQ ID NO: 172626 - DNA, 643 bp, Homo sapiens
  misc_feature: GYAE6OF02FYQCY.27.78.H01.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggngaaatcacatcacctgccgggccagtcagagcgttggtagtancttacacgtggtaccngcagaagccaggtcagtctaccaaagcctcctcataccaagttatcgccttacccgagttccctttctcgacggggtcccctcggtacggttcgacgttggcgaggtcggactcgtcgggacctacgtactttaccgacccctccgaacctactactaaacgtacgacccgttggaaacgtccgtaagaaagtaacgtcgtaccgtagtacctaaaccttttactttaaccgttcgttactattaccgagtaacctttacgttacccttttaacctagtacgttagacttcctaccgttcccggaccgaaggaccaaccgtagtaggtaacgtaacgttaaacgtacgtggtacgacgtacgacctaccgtagtacttcgtacttaccg

SEQ ID NO: 172627 - DNA, 752 bp, Homo sapiens
  misc_feature: GYAE6OF02HALQ7.27.78.H01.1.454.CMB.1.raw
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggtagtgagcaaaactagacaagtcaaggcaggaagatgtgccatcacaactcattgggtttctgctgctcgttcggtccgtagcctcccgagggggtgaaaagttggtggctggacctgacgtctccagtactttcagtctntgacctcaaaggagaaagtcaaccatccactacggcccgggaccaggtacagacggtcggtttaggtaggttaacgccttaacaccgtcgggtaacccaggctaaaggaacgacccgtaagggttacacggtacctaaccgaaacgcctacccttagaccttagtaaaacgtacgtcgtacccgttaccctacgttccgttccttccggtaaccggggtccccgttacgtacgggttacgaggtcggtccgaacggtttgggaacgtttccgcggggaactacgtaacccgttttacaccccccttacaacccgaatttacccgaaaagtacccggtaccgttaacgggtaacggtaacgtacggtaaacggtaacgtagtaccgttaggaaccttaaacgttaactttacgtacgtactaattaccgaagtactaaccgtttactacttaactagtactactactaccgtcggaccaacgggacgtaacgtaccgtagtacgtaaagtagtacgtaacgtcgtacgcgtcacgaccgtaactcgttacgttcc

SEQ ID NO: 172628 - DNA, 654 bp, Homo sapiens
  misc_feature: GYAE6OF02GVM7T.27.78.H01.1.454.CMB.1.raw
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
  modified_base (381)..(381): a, c, t, g, unknown or other
  misc_feature (381)..(381): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccagggtgaaattgtgctgactcagtctccagtactttcagtctgtgactccgaaagganaaagtcaccatcactggccggccagtcagagtcgttggtagtagctacncgtggtacagcagaacgcaggtcagtcaccaaagctcctcatacaagtatgtaccttcccagttcccttctacgacggggttccctggacggttcagtcggngagttggtactcgtaggacaacgtctttcccacctacgaccctataccgtaaataccgaccgttaggaacgcgtacgaagtacttgaccgtcgtaacttaaacgtttactttacgttacgtacgtaacttacgtaaacgtaaccgtttaacctttacccgttttaccgttaccgtaagttacgtaacccttaccgttaacccgtttacccggaaccgtaaacgggaccgtaaccggttaacggtacgggtaaccgtaacgtttaaaacccggg

SEQ ID NO: 172629 - DNA, 834 bp, Homo sapiens
  misc_feature: GYAE6OF02G0ITL.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcaacaactcagtttgggtttctgctgcgttcgtcgggtccacgcccgtacggagggtagtaagttcgtgctacgactcgacgttcctccgtagttacctttcacgttcgtacgtacgtaaccgtaaacggaaaaggtaacgaaacgtaccaacctacgtaccgaccggtaccggacccggacgtacggtacgaaggtacggtcggtttaggtaacgttaccttaccttaaccgtacggttaaccggtaacgaacggtacggaacgtaaccggtccggtaacggtaccgttaaccgtacccgtaaccgtaaccgtcccttacctacgtaactaacgtaaacgttctacccgttacccgttacccgttacgttcccgttacccggtacccgggttacccgggttacctggttaaccgtccggtacggtacgacggtaggtccggttacgtacggtaaccgtaccttacctacccgttacctaccctacctaacgtaactaacgtacgaccggtagtacgaacgtacgtacgacgttagtactaaccgtactaacctttagttactacgtactacgtacttaaccgtacgttaacttaaccgttacgttacgtactaccggttaccgtacgttaacccgtacccggaacggttaacccgggaacgttaccggaacttaacgggaacgttaccgtaaaccgtacgg

SEQ ID NO: 172630 - DNA, 667 bp, Homo sapiens
  misc_feature: GYAE6OF02GOMSU.27.78.H01.1.454.CMB.1.raw
  modified_base (494)..(494): a, c, t, g, unknown or other
  misc_feature (494)..(494): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaacgtcaccatccacctgccggcagtcagagcgttaggtagtagtctacgactggtaccagacagacgcgaggtcagtctacaagctcctcactacaagtatcgaccttacccagttccttcgtacggtaccggggtcccctacggtaggttccaggtcggcgtaggtcggtacgttcgtacgggtaccacgttactttaccaccccttcaaccctataccaaactacgaccgtagggaacgtacgtaggtaaacgtcgtagaccgtacgtacctaaacttacttaccgtntactactactacgtacgttacctttaacttaccgtactagtacgtactaccgtaccttaccggaacgaacggtaccgtaccggaagtacggtaaacgttaaaccgttaaaccgtaacggttacggttaacggtacggtacggtacctaccggtacgttaccgttacgttcccg

SEQ ID NO: 172631 - DNA, 667 bp, Homo sapiens
  misc_feature: GYAE6OF02ITF59.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggttaaattgtgctgactcagtctccagtactttcagtctgtgactccaaaggagaaagtcaccatcacctgccggcagtcagagcgttggtagtagtcttacactggtaccagcaagacgccgaggtcagtctaccaaagctcctcactcaagtatcgccttcccacgttccttccgtcgtaccggggtcccctacggtacggttcgaggtcggcgaggtgacgttcgtgggacactactttccaccctcacctactacaagtacgccgtaggaacgtctacgaagacgtgtctacggacttaacgtttaacttacgttacgttacaacgttaccgtaaacgtaacgtttaaccttaaccttttacccgttaacgtaacggtttacgaacctttacccgttaacccggttacccggtaacccggtaaacgggtaacccgtaaccggttaaacgtaccggggtaaacgttaaaccgtaaaccggttaaccggg

SEQ ID NO: 172632 - DNA, 693 bp, Homo sapiens
  misc_feature: GYAE6OF02IBZBK.27.78.H01.1.454.CMB.1.raw
  modified_base (615)..(615): a, c, t, g, unknown or other
  misc_feature (615)..(615): n is a, c, g, or t
tcagagcgtcgtctcacgaccggtgctcgatttagtgtgagtagtttgggtttgggggcatgagcaaaactgacaagtcaaggcaggaagatgttgccatcacaactcattggtttctgctgctctgggttccagcctccagggtgaattgtgctgactcgagtctcagtacttcagtctagtcgactaccgaaaaggacgtaaacgtcaccatccaccgtgcccgggccagtcagagtcgttgggtaatacgtacttaccacgtggtaccagcaacgaagccgtaggcctagtcctacaacgtcctacctcatacgaagtatcgaccttcccacgttccctacgtcgtaccggggttaccccctggtaacggttcgtacgtcggtactaggtcggtcgtacggttacgggaacttcgtaaccgttttcccaacccctactacccaataaccgtaacttacggtccgtaacgggtaacgcgtaacgtaagagttacgtcgtaacggtccttaaaacgtttcttactttacgtactaacgtacaggttaccttaaccgttaccgtttaaccacgtaagtataccttaccgtaaccggttacggaaccgtacggaanaccggaagtacggaaagttaaaccgttaacgaaacgttcgttaagcggtaacctaccgaccgtattccgtgttacccg

SEQ ID NO: 172633 - DNA, 705 bp, Homo sapiens
  misc_feature: GYAE6OF02HVXV8.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgagggtnaaattgtgctgactcagtcctccagactttcagtctgtgactaccgaaaggagaaagtcaaccatccaccgtcggcccggacagtcaggacgtcggttaggtagtagccttacgacgtggtaccagacagaacgccgaaggttcaacgttcctaccgaaacgccttcctacaacttacgtaacgttacgtcgtccttacccgacgttcccgttccgtacggaccggggttcccctacggtacgttaccgaggtcggtactagggtacggacttcggtacggaactaccgtacgtttcccaccctacctactacgttaacgaacgtacgaccgtagggacgtactaggaacgtactcgtaccgttacgtaacctaaactttacgttacttacgtaccttactacgtaacgtaaccgtttaccttacctttacccgtacgtacgtaacgtacccgttacgtaacccggtttacggaaccgtaacggtaccgtaaccgttacggtaaggtaaccgttaacgttaaaccg

SEQ ID NO: 172634 - DNA, 696 bp, Homo sapiens
  misc_feature: GYAE6OF02H4D12.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcatttgggtttctgctgctcgtgggttccagcctccaggggtgaaattgtgctgactcagtctccagtactttcagtctgtgacctaccgaaaggagaaacgtccaccatccacccgtcggccggccagtacagaggtcggttggtagtagtcttacacgttggtaccagcagaacgccgtaggtacacgtcctacaacgtcctcctacataccaagttatcgtccttaccctacgttccttccgtccggtacccgggttccctacggtcggttccgaggtcggtacgtcggtacgtagtccgtcgggacctacgttacctttacccacccttacaaccctaactacgtaacgtaccgtaccgtaaggaacgtcgtaagtaacgagttacgcgtagtaacttacgttttaattacgttcttactaactacgtaacgttaaccttaaccgtttaccttaacccgtaagtacgttaacgtcctaccgttacccttaccgggaactaacggacgtacgaccggttaagaacgtaaacgttaacgcggtacgtacgacgttacgacgtaacctcgttacgttccgtacttacccg

SEQ ID NO: 172635 - DNA, 708 bp, Homo sapiens
  misc_feature: GYAE6OF02IVS7I.27.78.H01.1.454.CMB.1.raw
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
tcagagcgtcgtctcacgaccggtgctcgatttagtgtgagtagtttgggtttgggggatcttaaaagaggttctttctctgggatgtggcatgagcaaaaactgacaagtcaaagggcaggaagatgttgccatcacaactcattgggtttctgctgcttctgggttccagccctccgaggggtanaaattggtgcctgactcacgtctccagtacctttnagttctgtacgactaccgaaaggagtaaacgtcaccactccaccgtcggcccggccagtcacggagtcgttaggtagtagtacttacactgacagcagaagccgaggtacntcctaaccgaanacctctcgactactaagtatcgtaccttcccgacgttcccttacgtacccgtaccgggggttaccccctcggtaacgggtttctaacgggtcgtacccggtaaggttggacctttaccggtaggggtaccctaccgttaacgtttccccaccgtacccaacctaacgttaccaaactaccggtaccgtagaaggtactaaggtaacgtcgtagacctagacttaacttaagttacctcgtactacgttctacggtaacttaccgtttaacttaccgttacgtaacgtcgtacgtaccctaccggtaccgtaaccggaaacggttaccgaaccgtaccggtaaggaacggttaacctaaccggg

SEQ ID NO: 172636 - DNA, 571 bp, Homo sapiens
  misc_feature: GYAE6OF02JKWEF.27.78.H01.1.454.CMB.1.raw
  modified_base (148)..(148): a, c, t, g, unknown or other
  misc_feature (148)..(148): n is a, c, g, or t
  modified_base (186)..(186): a, c, t, g, unknown or other
  misc_feature (186)..(186): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (520)..(520): a, c, t, g, unknown or other
  misc_feature (520)..(520): n is a, c, g, or t
  modified_base (544)..(544): a, c, t, g, unknown or other
  misc_feature (544)..(544): n is a, c, g, or t
tcagagcgtcgtctcacgaccggtgctcgatttagtgtgagtagtttgggtttggggtagtgagcaaaactgacaagtcaaggcaggaagatgttgccatcacaactcattgggtttctgctgctctgggttccagcctccaggggtnaattgtgctgactcagtctccagtactttcagtctcgngtactccaaaggagaaaagtccaaccatacaccgttcgaccggggtccaagtcaaggagccgttggagtancttacncgttgaccagactaagagcccaaggtcagtctacaagctccncatcaatcngtactccgaacttcnctcgacgggtccctctaggttcagtggactaggtgctcgtggaacnactttccaaccccggttnaacactccaagacncggtacgtaanccgtggaacgtactagcctaggcttaacggtattcgacttacagttccgaatacgttacctaacgtttaccncgtanacgtntacctacgtctaccggaganacctgcgtaagtacaaggtcgtangtaccaagcaagtctacttagcttacg

SEQ ID NO: 172637 - DNA, 624 bp, Homo sapiens
  misc_feature: GYAE6OF02IO0VE.27.78.H01.1.454.CMB.1.raw
  modified_base (184)..(184): a, c, t, g, unknown or other
  misc_feature (184)..(184): n is a, c, g, or t
tcagagcgtcgtctcacgaccggtgctcgatttagtgtgagtagtttgggtttgggggatcttaaaaagaggttctttctctgggatgtggcatgagcaaaaactgacaagtcaaaggcaggaagatgttgccatcaacaactcattgggtttctgctgctctgggttccagcctccaggggtnaaattgtgctgactcagtctcagtactttcagtctgtgactccaaaaggagaaagtcaccatcacctggccggccagtcagagcgttaggtagtagcttacacgtggtaccagacagaagccaggtcagtactaccaaagcctacctacactacaaagtatgccttacctacgttccttctcgtaccgggtccctagacggttcacgtgcagtggatcgtaggactacgtactttccacctacacatacgaatacgcgtaggaacgtactaggaagtacgtacgacgtacgtacgtaactttacgtactagtactatacgaagtaacgtaacctttacctttaccgtacgtaacggttactaacttacccgtaaccgtttaccggaaccgtaacggggaacctaaccggtaacgtacgggtaacgtaactttaaaaccgg

SEQ ID NO: 172638 - DNA, 668 bp, Homo sapiens
  misc_feature: GYAE6OF02GZ0WV.27.78.H01.1.454.CMB.1.raw
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctctgggttccagccctccgagggggtanaaattgtcggctgactcagtctccagtactttcagtctgtgactaccgaaagganaaagtccaccatccacctggccgggcagtcagagcgttggagtagcttacacgtggaaccagcagaacgccaggtcacgtactaccgaaagcctacctacatacaagtatcgtccttccgacgttcctttcgtccgacggggttcccctaggtacggttacaggttacggctaggtgggactcgtagggaaccattactttaccgacccctactaccctaataccgtaaataccggactagggaaagtccgtaaggaaagtagttcgactacgacttaaacctttattaacgttgttaccacttccgtaaagtaacgtttaaccttaactttaacccgtataaacgttgtaactaccgtacccgtttacgggaacctaaagggaccaaggacgtaggaagtaaacgttaaaccgaacgttggtacgtacagtccgtaaccctagttcttacggttaccttcc

SEQ ID NO: 172639 - DNA, 802 bp, Homo sapiens
  misc_feature: GYAE6OF02JPA3Q.27.78.H01.1.454.CMB.1.raw
  modified_base (150)..(150): a, c, t, g, unknown or other
  misc_feature (150)..(150): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagagcgtcgtctcacgaccggtgctcgatttagtgtgagtagtttgggtttggggatcttaaaagaggttctttctctgggatgtgcatgagcaaaactgacaagtcaaggcaggaagatgttgaccatcacaactcattgggtttcngctgcttcgtcgggttccagcctccgaggggtagaaattgngctgacnctgtctaccagtacttcagtctgtgactaccaagganaagtcaccatccacgtcggccggacntcacggagtcggttggtacgtacgtcttaactacgtacggtaccgacgacaacggtaagccgacggtactacgtacctaaccggaaagtcccttacctacgtactaaccgaaagttccgtactccccggtttaccgtacgttaccccgttcgttaacccgggtacccggggttcccccgttaagggtaccggttttaacgacgggtacggtaccggtagggttaccggtaacggtttaccgggtaacggggtaaaccttaacccgtttaaaccgttttacccccgtaaccccggttacccaaaccgtaacgttaaccgtaacgtaaccccgggttaccgtaaggggtaacctacgttacggaaacgtcgtacgtccgtacgtaaccttacggtttacttactcgttaatccgtaacgtacggtaacttacgtttaaccgtactttaccgagtttaacgctttaaacccgtaccgttaccggaaacccgtaacgggtacctaaccggtaaccggttaacggtaacgttaaacgttaaccggg

SEQ ID NO: 172640 - DNA, 677 bp, Homo sapiens
  misc_feature: GYAE6OF02J14FX.27.78.H01.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctcgagggtgaaattgtgctgactcagtctccagtactttcagtctgtnactccaaaggngaaagtcaccatcacctgccgggccagtcagacgtcgttggtagtacgtcttacgactggtaccagcaggacgtccgaggttcgagtcctaccgaagtcctctacatacgtaaagtctagtccttacccgtacgttccttccgtccgtaccggggtcccctcggtacgttacgagtcggacgtgttcggattcgcggaactcgactttcccacctctaaccataccgtatacgacgtaggactgtaacggagtagtcgtacgacgtacctttaacttaatttcgtacgttacctattacgaacgtacgtttaaccttaccgttaacctagttaaccgtattaccgttacctaccggtttaccggaacgtacgggtaacctaggtacgtaacggaaacgttaaaccttaacggtaacggttcgttaccggggtacttaccggaacccgttaacgttacccgttacggttctttaaccccgg

SEQ ID NO: 172641 - DNA, 684 bp, Homo sapiens
  misc_feature: GYAE6OF02IG8O8.27.78.H01.1.454.CMB.1.raw
  modified_base (273)..(273): a, c, t, g, unknown or other
  misc_feature (273)..(273): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtcctccagactttcagtcgtgtgacctaccaaaggagaaacgtccaccactcacctcggccgggcccagtcgagaggtcgttggtagtacgtcgttacacgtcggtaccngacgagaagccgaggtcgacgtcctaccaaagcctcctctaactcaaagttactcgtaccttccctacgttaccttccgtaccgtaccggggttcccccgtcggtacggtttcgaggtacggcgtaggtggtatcggaggtaccacgttaacttcctaccctaccaccgtactactaacgtacgtactacggaacgtacgtaggaagtaactcgtacgcgtaacctaactttacgttacgttacttactaactacgtaacgtacgttaacctttaccgttaacctactaagtacgtactaaccgttaccgtaccggaaaccgtaacggaacgtaccgtagtacggtaagtaacggttaacgtaccgtcggttacgtacgtacgactaccgtactcgttccgtacttacccg

SEQ ID NO: 172642 - DNA, 852 bp, Homo sapiens
  misc_feature: GYAE6OF02GI9MD.27.78.H01.1.454.CMB.1.raw
  modified_base (147)..(147): a, c, t, g, unknown or other
  misc_feature (147)..(147): n is a, c, g, or t
  modified_base (339)..(339): a, c, t, g, unknown or other
  misc_feature (339)..(339): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtctccagtactttcagttcgtgtgactaccgaaaggagaaacgtcaccatccaccgtggcccggcagtcagacggtcgttaggtagtagtccttaacaccgttggtacccgaggcaagaacgccgaaggttcgacgtactacccgaagtccttccctacacttacgtaaacggtnttaccggtccccttacccgtacgtttcccctttaccgtacgggtaccccggggtttacccccttacgggtacgggtttacgacgggttacgggaccgttaagggtcggttacgtacccgggttacgggaacccttaacccgttaactttttacccccgaaacccccgtcctaaacccgtaatttaccgtaaaaccgttcccggtaaccgttaacgggtaaaccgtaccgttaagtaaaggttagtaccgtacggtacgttaacccgttaaaccgttttaccttaacgttacgttaaccgttacgttaacgttaaacgttaaccgttttaaccctttaacccgttttaaccgttaccgtaagtttaccgttaaccttacccgttaacccggttaccccgggtaaccggtaaccggaaccgtaaccgtacgtaacggtaaacgttaaacgttaaaccgtaacggtacggttcgtaccgtagtaccctaccgtacgttcgttccgttacttacccg

SEQ ID NO: 172643 - DNA, 615 bp, Homo sapiens
  misc_feature: GYAE6OF02IQ36F.27.78.H01.1.454.CMB.1.raw
  modified_base (182)..(182): a, c, t, g, unknown or other
  misc_feature (182)..(182): n is a, c, g, or t
  modified_base (279)..(279): a, c, t, g, unknown or other
  misc_feature (279)..(279): n is a, c, g, or t
  modified_base (588)..(588): a, c, t, g, unknown or other
  misc_feature (588)..(588): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtggttccagccgtccgaggggtanaaagttgtgcttgactctagtctcctagtacttttcgacgtctgtgactaccgaaaggagaagtcaccatccaccgtcggccgggacctagtcaggngtacggttggtagtagtcgttacacgtacgtaccagtcagaacgtcgaggtctacgtctacaacgctcctcactacaagtctacgtccttcgtacgttccttctcggacggtccctagtcgttcagtcgagtagtgctgtacgtactactacgttccacctactacgtatacgatcgcgtagacgtgagatacgtctcgtacgtacctaagtttactaacgttcgtactaactacgtacgtaactttaccgttaacctttacggtactacgtaacgtactccgtaacttaccggaacgtacggtaccgngtaacgtacggtaactagttaaaccgg

SEQ ID NO: 172644 - DNA, 717 bp, Homo sapiens
  misc_feature: GYAE6OF02GJA2S.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccagggtgaaattgtgctgactcagtctccagtactttcagtctgtgactacaaaggaagaagtcaccatcacctcggccgggccagtcagacgtcgttaggtagtagtaccttacgacgtcggtaaccgacgacaagaacgccgacggtcagtcctaccaaagtcctcctacatactaagtatcgtcttcccacgttccttcgtcgtaccgggtcccctcggtacgttcgtacggtcggacgtaggtcgtacgtcggtagggtacctactactttaccgaccccttaaccgaacctacgtaccaacgttacgtaccgtaacggacgtacgtaacgaaagtacgtgtaccgtacggttaacctaaacgttttacttaacgttacggttactaacgttacgaagtttaaacgttaccgtttaaccttaaccgtaacgtaacgtacgtaacgttacccgtaacccgttcggtaaacccggaacgtaaccgaacggtaccgtaacgggtaaagttaaaccgttaaacgtaacggttacggtcgtaccgtacgtaccgtacgtaccttacgtatttacccg

SEQ ID NO: 172645 - DNA, 676 bp, Homo sapiens
  misc_feature: GYAE6OF02GJ3XE.27.78.H01.1.454.CMB.1.raw
  modified_base (572)..(572): a, c, t, g, unknown or other
  misc_feature (572)..(572): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggtccagcctcgagggtagaattgtgctgactcagtcctccagtactttcagttctgtacgacctaccgaaaaggagtaaacgtccaaccatccaccgtcggcccgggaccagtcgagacggtcggttggtagtacgtacttacgtacgtacggtaaccagtacagaacgccgtaaggtcacggtcctaaccgaaacgtcctacctactaactacgtaagtactcgtccttacccgacgttccttcgtaccgtaccgggtcccctaggtacggttacgaggtcggacgtacggtaggtacttcgggacggtaactaccgtactttccccgaacccttaccgacctaacgtacaacgtacgccgtaaggacgacgtagaagcgtcgtactacgtaactaacgttacttacgtntactagtcgaagttactacttaccgttactacgtaagtcgtactacccgtaccggtaacgtaccgaaggtacgtacgtacgtacggaacgttaacgttaaccgg

SEQ ID NO: 172646 - DNA, 743 bp, Homo sapiens
  misc_feature: GYAE6OF02I87U7.27.78.H01.1.454.CMB.1.raw
  modified_base (352)..(352): a, c, t, g, unknown or other
  misc_feature (352)..(352): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggcagtcagagcgttggtagtagcttacactggtaccagcagaagccaggtcagtctaccaagcctcctcatcaaggttatcgtcttcccagttccttccgtcgacggggttcccctcgtaggttcaggtggacnggtggatcgtagggacactactttccaccctacaaccctatacctaactacgtacctgggtaaacgtccgtaaggaaacgtacgttcggacttacggaacccgttaaacttttaacgtttacgttacgttactaacgttaaccgtaagggttaaaccttttaacccgtttaaacccttttttaaccccttaacggttaaaagtttccgtaacgtttaccccgttaaacccggtttacccgggaacccggtaaacggggtaacccgtaaccgggtaaccggttacggggtaaaacggttaacggtttaaaaaccccggaaacggtttacgggttaccggtaccggttacggaaccccgtaacgttaccggttaccgtttacggtttaacccg

SEQ ID NO: 172647 - DNA, 699 bp, Homo sapiens
  misc_feature: GYAE6OF02GLD3F.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtgaaattgtgctgactcagtctccagtactttcagtctgtgactccaaaggagaaagtcaaccatcacctcggccgggccagtcagagcggttggtagtagcttacacgtggtaccgagacagtaagcctaggtaccagtctaccaaacggtcctcctcaatactaagtacttcgccttaccctagttccttactccggtacggggtcccccttggtacgggttccaggtcggctacggttggagtcgtgggacctactactttccacccctacaacctatactaactacgtaccgtaggtaacgtctagaaacggtagtcgtctacgtaaccttaacttaacttacgttcgtactaacttacgtaagttaaccgttaaacctttaaccgtttaccttaacgttaacggtacaaccgtttaccgtaccggtttaaccggacgtaaaaccggtactaaccgggtacgtaacgggtaaagtaaacgttaaaacccgttaacggtacggttacggtcgtaccgtaccgtaacctacgttacttccgttacttacccg

SEQ ID NO: 172648 - DNA, 1001 bp, Homo sapiens
  misc_feature: GYAE6OF02F0PBH.27.78.H01.1.454.CMB.1.raw
tcagagcgtcgtctcacgaccggtgctcgatttagtgtgagtagtttgggtttggggggcatgagcaaaactgacaagtcaaggcaggaagagtgttgccatcacaactcattgggtttctgctgctctgggttccagcctccgaggggtgaaattgtgctgactcagtctccagtactttcagtctgtagactcgaaggagaagtcaccatcaccgtcggccgggccagtacagacgtcgttggtagtacgtacgttacaccgttcggtaccctagaccgagtaacgccgtaacggtcacggttcctaccgaaaaggtccctaccctactaactaccgtaaaggtactacggtccttaccccgtagtttcccgtttacgtccggtaccggggttcccccgttacggtacggttaccgtagggttcgggacctagggttacggtacgttacggtacgggaccctaacgttacgttaccccgtaaccctcccgtaaacccgtacgtaaccgtaaaccgttaccggtacccgttaaacggggtaacgtaaccggttacgggtaaaacgttacgtacggtaacccgtacgggttaaaccctttaaacctttaaacggttttaaccgtttaccggttaacccgttaaaccgttaccgtaaaacggtttaaacccgtttttaaacccgttttaacccgttttaaaaccccggtaacggttaaaaccgggtttacggttaaaccccgtttaaccccggtttaaaacccgggttttaaaccccgggtaaaccccgggttaaaacccgggtaaaccccgggtttaaaccggggtaaacccggggttaaccggggttaaaaaacccgggtttaaaccgggttttaaaaaaaccccgggtaacccggttttaacgggggttaccccgggttaaggtttaaaccccggtaacccccggtttaaacccccggtaaccggttttcccggtttaacccgggttttaaccccccgg

SEQ ID NO: 172649 - DNA, 740 bp, Homo sapiens
  misc_feature: GYAE6OF02F98PK.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgaggggtnaaattgtgctgactcagtcctccagtactttcagtctgtcgactccaaaaggagaacgtcaccatccacctggccggcagtcaggacgtcggttggtagtagtactacacgtggtaccaggcaagaacgccgaaggtcacgtcctaaccaaagtcctcctctaatactaagtagtcgtccttacccgacgttcccttaccgtccggtaccggggttccctggtacggtttcgaggtcggacgtaggtggacttcggtacggactacgttactttacccgacccctctaaccataactaacgttaccgaccgttaagggaactaccggtaaggtaaacttacgtacggtaccttaacgtaacctttaaacgtttaaccgtttacgtacgttaacttaacgtaaccgttaacgttaacgtttaaacccttttaaccttttaaccgacgtttaacggttaaccgtaacctttaccccgttaacccggttaccggtaaacccggtaaaccgggaaccgttaccggtaaacggtacggttaaacggttaaaccgttaaaacccgg

SEQ ID NO: 172650 - DNA, 699 bp, Homo sapiens
  misc_feature: GYAE6OF02I1R03.27.78.H01.1.454.CMB.1.raw
  modified_base (178)..(178): a, c, t, g, unknown or other
  misc_feature (178)..(178): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtnaaattgtgctgactcagtctccagtacctttcagttctgtgacctaccgaaaaggagtaaaacgtccacctatccaccgtggcccgggccagtcagagtccgttggtagtagccttacactggtaccagcaaggaagccgaggtcagtcctaccgaaacgcctcctacgtacttaccgaaagtacttaccggtccttacccgtacgtttaccccttcgtacccggtacccgggggttccccttaccgggtacggtttaccgtaaggtcgggtcctaacgggtcggtactcggtacggactactaccgtttcaccccttcacctactaccgtaataccgtccgtaaggtaactaccgttacggaagtaacgtcgtaccgtcgaaccgttaacgtttacgtacttaggttacgtatacgtaacgttaacgttaccttacgttactacgacgttcgtacctacgtaacgttacccggtacgtaacgtaccggacgtacggtacggtaaccgtaaggttaacccg

SEQ ID NO: 172651 - DNA, 655 bp, Homo sapiens
  misc_feature: GYAE6OF02HDEZ8.27.78.H01.1.454.CMB.1.raw
  modified_base (617)..(617): a, c, t, g, unknown or other
  misc_feature (617)..(617): n is a, c, g, or t
tcagagcgtcgtctcacgaccggtgctcgatttagtgtgagtagtttgggtttggggatgagcaaaactgacaagtcaaggcaggaagatgttgccatcacaactcatttgggtttctgctgctctgggttccagcctccaggggtgaaattgtgctgactcagtctccagactttcagtctgtgactaccaaaggagaaacgtcaccatccaccgtgccgggccagtcagagcgttggtagtatcttacactggtaccagcagagccgaggtcagtctcaaacgctacctcatcaagtactcgtccttcccacgttccttaccgtccggtaccgggtccctcggtacggttcgaggtcggtacgacggtggacgtcggtacgggactacgtactttaccacccctacgacctataccgaatttcgaccgttagggaacgtcgttaaggaagtacgtggtcgtacgtacttaacttttaacgttactacgttactaatccgtaagtaacgtttaccttaactttaccgtaactacgtagtaccttaccgttaccgtccgggaaccaagggtaccgacgtacgtacggtacgtaaactaaccgtagttaggaccggtntacggaccctactacgtttacttccggttaccttaccg

SEQ ID NO: 172652 - DNA, 680 bp, Homo sapiens
  misc_feature: GYAE6OF02GI7SJ.27.78.H01.1.454.CMB.1.raw
  modified_base (147)..(147): a, c, t, g, unknown or other
  misc_feature (147)..(147): n is a, c, g, or t
  modified_base (654)..(654): a, c, t, g, unknown or other
  misc_feature (654)..(654): n is a, c, g, or t
  modified_base (661)..(661): a, c, t, g, unknown or other
  misc_feature (661)..(661): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaattgtgctgactcagtcctcctagtactttcagttctgtcgactaccgaaaaggacgtaaagtccacactccaccgtcggcccgggaccacgtcaggacgtcggtttggtacgtaggcttacacgtcggtaccagacgagaacgtccgagtcgacgtcctacgaagccttcctatactacgaagtctacgtcccttaccgacgtttcccttacgtaccgggtacccggggttccccgttacggttacgggtttaccgaacgggttcggtacgtacggtcgggtacgtcgggtacggtacctacgttacttaccaccgtacctaactactaactaacgtacgaccgtaggaaacgtcgtaagaacgtcgtacggctaacgtactaacgtttacttaacgtcgtactacgtacctaggtaacctttacttaaccgttactaggtactacgtactcctacgtacgacgaacgacgacgtagtacggtaactaacgttaacgcgttacgntacgacncgtactgtctacgttctac

SEQ ID NO: 172653 - DNA, 725 bp, Homo sapiens
  misc_feature: GYAE6OF02GGN8X.27.78.H01.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcacatcacctgccggcagtcagagcgttggtagtancttacacgtggtaccagcagaagccaggtcagtcctacaagctcctcatcaagtatgaccttcccagttccttcgtccgacgggtcccctaggtacggttcaggtggacagtggactcggtagggacctactacgtttccacccctcgaacccatactaagtacgtccgtacggaactacgtagaaagacgttacggaccgtacggtaaccttaaaccttttacgtttaccgttacggttacctaagttacccgtaaagggttaacctttaacccttttaaccgttttaacccttaacggtaaaccggtttacgtaccgtttaaccccgttacccgtttaacccgggaaccggtaaaaccggggtaaccaaccggttaaccggtacggggtaaaagtttaaccgtaaaaaccgggttacgtacggggttacgtaccgttacggaacccgttaaccgtacgtttacccgttacggttaccctttacccg

SEQ ID NO: 172654 - DNA, 820 bp, Homo sapiens
  misc_feature: GYAE6OF02HGN7R.27.78.H01.1.454.CMB.1.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtgaaattgtgctgactcagtctccagtactttcagttctgtanacctaccgaaaaggagaaacgtccaacctatccgaccgtcggccgggcagtacagagtcggttggtagtagcttacnctggtaccagcagacgccaggtcagtctaccaaagccttacctactactacgtaaagttacgtacgccctttacccacgttttcccttaccgtccggtaaccgggggttcccccttacgggtaacggtttaccgagggttccggacgtagggttcggtacgttcggtacgggtaacctacgtttaccgtttaccccgtacccctaacccgtaaccttaaactaccgtaaacgtaccggtccggttaacggaaacggtcgttaaacggaaacggttagtaccgtacgttaccgtaaccgtttaaaccttttaacgttacccttagggttaacctacgtaaacggttaaacggtaccgttttaaacccgttaaccgtttttaccccgtaacgttaaacggttaccggttaacccgttacccggttaaccccgttaaccccggggtaaacccggtaacggggtaaaccccgtacgggttaaacccgggttaacggtaaaccgggtaaacgtttaaaacccgggg

SEQ ID NO: 172655 - DNA, 685 bp, Homo sapiens
  misc_feature: GYAE6OF02FKKFG.27.78.H01.1.454.CMB.1.raw
  modified_base (212)..(212): a, c, t, g, unknown or other
  misc_feature (212)..(212): n is a, c, g, or t
tcagagcgtcgtctcacgaccggtgctcgatttagtgtgagtagtttgggtttggggatcttaaaagaggttctttctctgggatgtgacatgagcaaaaactgacaagtcaaaggcaggaagatgttgccatcacaactcattgggtttctgctgctctgggttccagcctccaggggtgaaattgtgctgactcagtctccagactttcngtctgtgactccgaaaggagaaagtcaccatccacctggccggccagtcagagcgtttggtagtagtcttacgactcggtaccagacagaacgcccaggtccagtcctaccgaaagcctacctcatacgaagtatcgcctttcccgacgttccctttccgtccgtaccggggttccccctacggtacggttcgaggtcgtacgtaggtcggtacttcgtacggggtaacctaacgttactttacccaccccttacaccctagttaaccaaacgttaccgccgttaacggaagtaccgtacggtaaagtcgtacgacgttacgtaacctaaacgtttacttacgttcgtaccgtaattaaccgaagttaccttaacctttaccgtttacctaacgtaacgtacgtactaccgttacccgtcggaaccgttaacggacgtacccggtaggtaacgtaacgtaacgtttaaaccgg

SEQ ID NO: 172656 - DNA, 755 bp, Homo sapiens
  misc_feature: GYAE6OF02ICXFK.27.78.H01.1.454.CMB.1.raw
  modified_base (178)..(178): a, c, t, g, unknown or other
  misc_feature (178)..(178): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccagggtnaaattgtgctgactcagtcctccagtactttcagtctgtgacctaccaaaggnaaagtcacaatccacctcggccggccatcagcgtcgttggtagtanaccttacgacgtggtaccaggacaagacgcctaaggtacacgttctaacctaacggtccgtacctacgacgtaaccgaaacgttattccgtaccttcccgaagttcccttaccgtaccgggaaccgggttcccctacgggaacggtttccgtaaggtcgaccgttaggtacggtaacgtttccgtaacggtacctaaccgttaccgttttccaaccccgttactaacccgtaattaccgtaaacctccggtaaccttaaccgggaaatcccgtaggtaaacgtaccgtacgtccggttaacgtaacccgttaaatttaccgtttaacccgtaggttcctaacgtttaccggagtaaaccgtttaccggtttaactttacccggtaaccgtttacgtaacgttccgttaaccctaccggtttacccggtaccggaacggtacgaaccggtaactcgggaaaccgtacgttaaacccggg

SEQ ID NO: 172657 - DNA, 604 bp, Homo sapiens
  misc_feature: GYAE6OF02IZOGM.27.78.H01.1.454.CMB.1.raw
  modified_base (438)..(438): a, c, t, g, unknown or other
  misc_feature (438)..(438): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggtttctgctgctcgtgggttccagcctcgagggtgaaattgtgctgactcgagtctccagctttcagtctgtcgactaccgaaaggagaaagtcacctatccacctcggccggccagtcagacgtcggttggtagtagcttacactggtacagcagaacgccaggtcacgtctaccaaagcctcctacactacaagtactgtaccttcccgagttcccttctccgtaccggggttcccctgtacggttcaggtcgcgagtggcgttcgtgggacctactaacgtttaaccccncgtaaccactacaagtacgtccgtaggaagtactagaagtactggcctgacctaatttacgttactgctaatcgaagtacttaacttaccgtttacatagtactacttaccgtaccgttccggacgtaaggcaacggtagtacggtaacgtaagtaaccgtaacgg

SEQ ID NO: 172658 - DNA, 788 bp, Homo sapiens
  misc_feature: GYAE6OF02IFA6K.27.78.H01.1.454.CMB.1.raw
  modified_base (473)..(473): a, c, t, g, unknown or other
  misc_feature (473)..(473): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtgaaattgtgctgactcagtctccagtactttcagttctgtagactaccgaaaggagaaacgtccaaccatccaccgtcggcccgggcccagtccgaggtacggtccggtttagggtaagttagccttaacgaccgttagggtaacccagacaaggaacgacccgtagggtccagttccgtaccaaaagcttccctcataccaagttagtcgtaccttccccgacgtttcccttcgtacgtacccgggtcccctacggtacggttcgtacggtcgcgtaggtcggaattcggtacgggaactagtacgtttcctacccgtacaacccgtntaaccaagtacgccgtaagggactcgtacgagaacgttcggcgttacgaaccttaacgttttacgttacgttacgttaccattacccgtaacgtaacgtttaccgttaaccttttaacccgtaacgtaacgttacgttaaccgttacccgttaacccggtttacccgggaccggtaaaacgggtaacctaaccggtaacggtaccggggttaacgttaaaacggtttaacccgggtaagttaccggggttaacggtaccgttacccgaaccttaacccggacccttttccgggttaccgtttaccctttaacccg

SEQ ID NO: 172659 - DNA, 768 bp, Homo sapiens
  misc_feature: GYAE6OF02HVPXG.27.78.H01.1.454.CMB.1.raw
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtagaaattgtgctgactcagtctccagtactttcagtctgtgactaccgaaaggagaaacgtcaaccatcaccgtcgccgggccagtcagagcgttggtagtacgcttacgacgtggtaaccagcaagaacgccgaggttcagtcctaccaaacgtcctacctcaatactaagtatcgtccttacccacgttcctttccgtaccgtaccggggttcccccttaggtacggtttacgaggttcgggaccgtaagggttcggaacgttccggtacggggaacctaccgtttaacgtttaccccgtaacccccttacaacccgtacttaaccgaaacgtttaccgggacccttaagggaaacgtccgttaaggaaacgtacgttcggtaccgttacggtaaaccttaaaccgttttacgtttaaccgttgtaaccgttaacttaccgtaaacggtaacgtttaaccctttaaccgtttacccttaacggtaaagtcgttaaccgttaacccgtaaccgtttacccgggaaccgtaaccggggtaacctaaccgggttacgttaacggggtacttaaacggttaaaacccggg

SEQ ID NO: 172660 - DNA, 1104 bp, Homo sapiens
  misc_feature: GYAE6OF02H24BP.27.78.H01.1.454.CMB.1.raw
  modified_base (141)..(141): a, c, t, g, unknown or other
  misc_feature (141)..(141): n is a, c, g, or t
tcagagcgtcgtctcacgaccggtgctcgatttagtgtgagtagtttgggtttggggatcttaaaagaggtttctttctctgggatgtggcatgagcaaaactgacaagtcaaggcaggaagatgttgaccatcacaactnattggtttctgctgctcgtggttccagcctcgagggtagtaattgtgctgactcagtctccagtacttcagttctgtagacctaacgaaaacggtaagaaacgtccaacctacttccaaccgtcggacccgggtaccgtaggtacccgaagtacgggttaccgggttttaggtaacggttaacggttacccgtttaaaccgaaccgttttaccggggttaaaacccgaaccgggtaacccaaaaagggaaaaccccgggtaacccccggttaaacgggggtttacccgtaaaaccgggtttacccgttaaaacccccggtaaaaaacgggtcccccttttaacccccggttaacccgtaaaaggtttaaccccgttaaaaaagggttttacgttaccccggttaccccccgtttttaacccccgaaaacccggtttttcccccccctttttaaaggggtttaccccccggggtttaaaccccgggggggttttacccccccgtttaaaccggggggttaaaccgggggtttttacccgtaacgggggtttacccgggggtaaaccggttaacgggggttacggggtaaaaccggtttacccggggtttaaccgggggttaaaccttaacccgttttaaccccggtttttaaacccccctaaccccccgtttaaacccgaacccttaaacgttaaacccgttaaacgtaaccgggtacccgtaagggtaaaccgttacggtaaggtaaccgttaagtccgtaacggttactaaaccgtttaaactttacgtttacgtaacgttaccaacgtttaaccgtaacggtaacgtttaacccgtttaaaccttttacccgtaaacgtaacggtttaccgtaaccttaaccccgtaacccggtttaccgaaccggttaaccgggaactaacccggttacggtaaacggttaaacgtaaacgttaaaccgg

SEQ ID NO: 172661 - DNA, 567 bp, Homo sapiens
  misc_feature: GYAE6OF02HQXV9.27.78.H01.1.454.CMB.1.raw
  modified_base (146)..(146): a, c, t, g, unknown or other
  misc_feature (146)..(146): n is a, c, g, or t
  modified_base (206)..(206): a, c, t, g, unknown or other
  misc_feature (206)..(206): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagactttcagtctgtgactccaaaggagaaagtcaacntcacctgccgggccagtcagagcgttggtagtagcttacacgtggtaaccagcagaagccaggtcagtctcaaagctcctcatcaagtctagcttcccagtccttctcgtacgggtcccctcggtaggttcaggtggcaggtggatcgtgggacactactttcaccctnaccctatccaaatacgtcctaggacgactgaagactgctcgactaacttntactgtacattcagtacgtacttacttaccctagtaagttacgacttaccgaccttaccggacgaacggacaccgacgtggaagtaacttaaacggaacgttaggtcggtacgtacgcctaaccgattcgttcgtctttacc

SEQ ID NO: 172662 - DNA, 818 bp, Homo sapiens
  misc_feature: GYAE6OF02G0AKM.27.78.H01.1.454.CMB.1.raw
  modified_base (145)..(145): a, c, t, g, unknown or other
  misc_feature (145)..(145): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtnaaattgtgctgactcagtctcagtactttcagtctgtgactaccgaaaggagaaacgtcaaccatccaccgtggccgggccagtcagagtcgttggtagtacgtcttacgacgtaggtaccagacaacggaagccgaaggtacacgtacctacccgaaaacgccgtccctacctaactaccaaggttactcgtacctttaccccgacgtttcccctttccgtaccggtaccggggttccccccgttcgggtaaccgggtttcgtaacgggttcgggaccgtaaggttacgggtaagttccgggtacggggtaacgtacccttaaaccgttttaccctaacccccgtacctaaccccgtacttaaccgtaaacttaccggtacccgttacgggaaacgtaccgtaaggtaaagtaacgttccggtactacggtaaccttaaaccttttacgtttaacgttcgtacgtaacttacgtaacgggttaactttaaaccgttttacctttaacccgttaacgtaaacggttacgtaccttaaccgttacccggttaccgggaaccggtaaaccggggtacctaaccggtacgttaagggtaacggtaacgttaaaccggtaacgtacggtacggtacgtacgtacctaaccgttactacgtttacgtacctttacccg

SEQ ID NO: 172663 - DNA, 768 bp, Homo sapiens
  misc_feature: GYAE6OF02G3GSC.27.78.H01.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctctgggttccagacctccaggggtnaaattgtgctgactcagtctccagtctttcagtctgtgactacgaaagganaaacgtcaacatccaccgtggcccgggactagtcagacgtcggttggtaagtacgcttaacacgttggaaccagcaagagccgaggtcacgtctaccaagctacctacgactacaagtactcgtacctcctacgttccttcgtcggtacgggtcccctcgtacggtcaggttcggactaggtaggactcgtagggtaccacgttacttaccgtacctaccacctaactacgaaacttacggtaccgttaggaaccgtacgtaacggtaaacgtacgtacgtcgttaacgtaccttaaaccgtttacttaacggttacgttacgtacttaaccggttaacgttaaccggtttaaacccttttaaccgtttaaacccgttacgttaaacgggttacctaaccgttaccgttacccggtttaaaccggaacccgggtaaaccgggttaaccgtaacccggttacggtaaccgggtaacgtaaaacggtttaaaccggttaacggttaccggtacggttacgttaaccggtacctaaccggttcctttacggttacttacccgtttaacccgg

SEQ ID NO: 172664 - DNA, 675 bp, Homo sapiens
  misc_feature: GYAE6OF02H3BLT.27.78.H01.1.454.CMB.1.raw
  modified_base (165)..(165): a, c, t, g, unknown or other
  misc_feature (165)..(165): n is a, c, g, or t
  modified_base (183)..(183): a, c, t, g, unknown or other
  misc_feature (183)..(183): n is a, c, g, or t
  modified_base (231)..(231): a, c, t, g, unknown or other
  misc_feature (231)..(231): n is a, c, g, or t
  modified_base (454)..(454): a, c, t, g, unknown or other
  misc_feature (454)..(454): n is a, c, g, or t
tcagagcgtcgtctcacgaccggtgctcgatttagtgtgagtagtttgggttggggatgagcaaaactgacaagtcaaggcaggaagatgttgccatcacaactcattgggtttctgctgctctgggttccagcctccaggggtgaaattgtgctgactcagtcnccagtactttcagtctgngactaccaaaggagaaagtccacagtccaccgtggccgggcagtcagngtcggttaggagtacgccttagacgtcggtaccagacagaacggccaggtcacgtcctaccaaagcctccgactactacaaagtctacgccttcccgtattcccgttcgtaccggtaccgggttcccctacggtacggttcacggtcgcgtacggtgtactccggtaggactacgtactttaccacccgtacacctacgtcaagtcacgtagacgtctagtanacgtcgtcgactaccgtaatttacgtattcggtatactactacgtaacgttaacctttactttaccgtaacgttacgtacgttacgtacccgttaccgttaacccgggacgtaaaccgggttacgaccggtaccgttacgggtaacgtaaaggtttaacccgtaacggtcgtaccggtacttccgaacggtaccttacgttaccgtccgttaaccttcccg

SEQ ID NO: 172665 - DNA, 898 bp, Homo sapiens
  misc_feature: GYAE6OF02H5OD8.27.78.H01.1.454.CMB.1.raw
  modified_base (148)..(148): a, c, t, g, unknown or other
  misc_feature (148)..(148): n is a, c, g, or t
  modified_base (588)..(588): a, c, t, g, unknown or other
  misc_feature (588)..(588): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctcgtggttccagcctcgaggggtanaagttgtgctgactcagtcctccagttactttcagtctgtcgtacacgaaaggagtaaacgcaaccatccaccgtcggccccgggtacaacggtaccaggtacggtacggtttaggttaaggtacttacccgttaaacgtaccgttaccgggtaaaccgaccggaaccgaaaggaacccggacccggtaagggttacctacggtacccttaaccgaaaacggtcctcctacctaacgtacctaaggtaacttcgtacccttacccgttaccgttcccgtttacgtacccggttaccggggttccccgtacggttaacggtttccgaaggtccggtggtaaacggtacgtacgttacggtacgggtaacttaaccggttacttacccgtaccccaacctaacccgaagtactaaacgtttaccgaccgtaaggggtaaccnggtaaacgggattacggacgtaccgtagttaacccgttaatttaaccttagtacgttaacagttaacggtaaacgttaacggttaaaccttttaaaccgttaaccggttacgtaaacggttacccgttaaaacgtttacccgaacccgttaaccggggttaaccgaaaaccggggtaacctaacgggtaacggtaaacgggttaataaaaacccgggttttaaccctaagggttaaccggtaaccggttaccgtccccgaacgtttaccccgtaaagttttcccggttaacttccccggttttaaacccc

SEQ ID NO: 172666 - DNA, 614 bp, Homo sapiens
  misc_feature: GYAE6OF02FZR7M.27.78.H01.1.454.CMB.1.raw
  modified_base (403)..(403): a, c, t, g, unknown or other
  misc_feature (403)..(403): n is a, c, g, or t
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcaccgtcgccggccagtcagagcgttggtagtagcttacactgtaccagcagaagccagtcagtctacaaagctcctcatcaagtatgccttccagttccttctcgacgggtcccctgtaggttcagtggctaggtggtatcgtgggacctactacttccaccctcacctatacaatacgccgtaggaacncgttagaacgtatgtccgtagacctaaactttacttactcgttacactacgtaagtacgttaacccttaacgtttaaccctagtaacgttactacgttacctaccgttacggaccgtaacgggaccacggtacgtagggtaacgtaaacgttaaacggacgttaggacggtacgtcggtaccctaacgtacgttaccgttacgtttacccg

SEQ ID NO: 172667 - DNA, 610 bp, Homo sapiens
  misc_feature: GYAE6OF02GAB11.27.78.H01.1.454.CMB.1.raw
  modified_base (148)..(148): a, c, t, g, unknown or other
  misc_feature (148)..(148): n is a, c, g, or t
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagagcgtcgtctcacgaccggtgctcgatttagtgtgagtagtttgggtttggggatgagcaaaactgacaagtcaaggcagggaagatggttgccatcacaactcattgggtttctgctgctctgggttccagcctccaggggtnaaattgtgctgactcagtctccagactttcagtctgtgactccaaaggnaaagtcaccatcacctgcccgggccagtcagagtcgttggtagtagcttaacactggtaccagcagaagccaggtcagtctaccaaagctcctcatcaagtntgcttcccagtccttctcgaggggtcccctcgaggttcagtggcagtggatcgtagggacacgtatttccaccccttcaaccctataccaatacgcctaggaacgctagaagtatgacttgactaacttattactgtacatcaagtagttaacctaaccgttttaccactaagtcgaacttccgtaacccgttaccggacccgtaaaggggacccaacggtaccgtagggtaacgtaaacgttaaaaccggtaaccttaggtacggtaccgtacggaccctaacccgtattaccgttacgttccttaaccg

SEQ ID NO: 172668 - DNA, 756 bp, Homo sapiens
  misc_feature: GYAE6OF02GSJGO.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtgaaattgtgctgactcagtcctccagtactttcagtctgtgactaccgaaaggaagaagtccaccatccaccgtcggccggccagtcagagtcggttaggtagtagtacttacacgtcggtaccagcgagaacgccgaggtacagtacctaccaagtcctacctcactacgtaagtactcgtccttcccacgtttaccctttccgttaccggtacccggggttccccgttaccgggttacggttaccgtacgggttcgggtacgtagggttacgggtacgttccggtacggggtaacccttaacgttaccgtttaccctacccccttaccgaacctacctacctaacgtaccgtaccggtaggtaacgtactaggaaacgtacgtacgtctacgtaacttaacctttattaccgtagtacctagtctaacgtacgttaacctttactttaacctacgtaagttccgtaacttaccttacccggtaccggtaaaccgacggtaaccaccggtacgtaaggttaaccggtaaacgtttaaaccggtacggttaaccggtcggtacgttaccgacccgtaaccgttaccgttacgtaccgttttaccccg

SEQ ID NO: 172669 - DNA, 748 bp, Homo sapiens
  misc_feature: GYAE6OF02GVIRL.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccggccagtcagagtcgttggtagtagcttacacgtggtaccagcaagaacgccaggtcagtctaccaaagctcctcatcaagtatcgccttcccagttccttctccgacggggtcccctcggacggttccaggtcggctaggtggatcgtagggactactctttccaccctcaacctataccaagttacgcccgtaaggaacgtacctaggaaacggtatcggacctaggtaccctaaacgttttaacttaaccgttcgttacctaagttaccgaaacggttaacgtttaaccctttaacccgtttttaaccccgtaacgtaaacgggttaccgttaaccttacccgttaaaccccggttttaccgggaaccccgttaaaagggggtaacccctaccggggttaaaccggttacggggtaaaaccggtttaaaaccggtttaaaaacccgggtaaccgtttaacgggttacgggtaacccttaccgggtaaccctaaccccggttacctttcccggttaacgtttaccccg

SEQ ID NO: 172670 - DNA, 642 bp, Homo sapiens
  misc_feature: GYAE6OF02GCB4Q.27.78.H01.1.454.CMB.1.raw
  modified_base (295)..(295): a, c, t, g, unknown or other
  misc_feature (295)..(295): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcactgccgggccagtcagacgcgttggtagtagcttacactggtaccagcagaagccaggcagtctaccaaagctcctcatacaagtntacgcttcccgagttcccttctccgacggggttcccccgtcgaggttcagtcggctagtggatcgtagggacacgtacttccaccctacaaccgatcaaactacgccgtaggaacgcttagaagatagcgtagacctaaacttaattactcgtactatacgtaagtaacgttaaccttaaccttttaaccgtactaacgtacgtaacgttacctaacccgtttaccggaaccggtaaacggggaacctaacggaccgttaagggaacgtaaacgttaaaacggtaaccttagggtacgtaccgtacgtaaccgaacccgttactaccggtttattcccgtttaaccg

SEQ ID NO: 172671 - DNA, 656 bp, Homo sapiens
  misc_feature: GYAE6OF02IDGMH.27.78.H01.1.454.CMB.1.raw
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (412)..(412): a, c, t, g, unknown or other
  misc_feature (412)..(412): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctgggttccagcctccaggggtanaattgngctgactcagtctaccagtactttcagtctgtgactaccaaagganaaacgtcacanccgacctgccggcagtccagacggtcgttggagtacgaccttacacgtggtaacccagaccgaaggaaacgcccgtaggtacaacggttcctaccgaaatcctacctacaatccaaaggttatccgtaccttacccgtcgttcccttacgtccggtaccggggttcccctaggttacgttaccgtaggcggtactaggtcgtntaccggtcgaactactacttacccacttccgaacacgttacaaacgtgcccgtaaggacgtactaggaagtactgaccgtagaaccttaactttagttactcgttactagtaccgtagtaaccttaccttaaccttacgttacgaagtactactacgtaccgttcgaacgaacgtacacgacgttaggaagtaacctaaagtacgtgtacgtcgtacgctaaccgtactcgttcctacttaccg

SEQ ID NO: 172672 - DNA, 589 bp, Homo sapiens
  misc_feature: GYAE6OF02I06LS.27.78.H01.1.454.CMB.1.raw
  modified_base (150)..(150): a, c, t, g, unknown or other
  misc_feature (150)..(150): n is a, c, g, or t
  modified_base (483)..(483): a, c, t, g, unknown or other
  misc_feature (483)..(483): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaaattgtgctgactcagtctccagtactttcagtctgtgactccgaaaaggagaaagtcaccatcaccgtgccgggccagtcagagcgttggagtagccttacacgtggtaccagacagaagccaggtcagtctaccaaagctcctcatcaagtatgccttcccagtccttctcgaccggggttcccctcgtaggttcaggtcggcgtacggtggtactcgtcgggactactatttccaccctcaccactcaatacgcctagaagctagaagtagtgctgacctaacttcttacgtgtacctatcgtagtacgttactactttacctacagtntactctaaccgtcgaccgtaagggaccacgtacgtacggaaggtaaccttaaacggaacgttgtaccggtacctcggacccgtaacctcgttacgttcgttacccg

SEQ ID NO: 172673 - DNA, 754 bp, Homo sapiens
  misc_feature: GYAE6OF02FM6D0.27.78.H01.1.454.CMB.1.raw
  modified_base (187)..(187): a, c, t, g, unknown or other
  misc_feature (187)..(187): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctcgtggtccagcctccgaggggtgaaattgngctgactcagtctccagtactttcagtctgtgactacaaaggagaaagtcacactcaccgtcgccgggccagtcgagaggcggttggtaagtacgtaccgttactacgttacggtaaccaggacgaacgtaaagccgtaaggtactaagtccgtaacccgaaaaggtcccttcccgtataacgtaactaaacgttcgtcgtacccctttacccgaccgttcccttaccgtaccggtaccggggttaccccctggtaacggttcgacgggttcgacgtaggtcggaacgttcggacgggtactacctactttacccacccgtaccaaccctaactactaaaccgttcggaccgttagggaaccgtactaggaacgtacgttacggacgtacgtaaccgttaaactttacgttaaccgttactaccgttaataccgtaacgtaacgtttaaccttaaccttaccgtacgtaaacggtcgtaaccgtttaccgtaccccggttaaccggaacccggtaaacgggacccgtaaacggtaaccggtacggttaacgtaaaccgttaaaccgg

SEQ ID NO: 172674 - DNA, 641 bp, Homo sapiens
  misc_feature: GYAE6OF02HBMPT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactccaaaggagaaagtcaccatccaccgtgcccgggccagtcagagtcgttggagtagcttacactggtaccagcagaagccaggtcagtctccaaagctcctcatcgaagtatgtccttcccagttccctttcgtccgtacggggttccccctcggtacgggttccaggtggcaggttcggatcgtgggacacgtacttccaccctcacccatacaacttacgaccgtaggaacgtcgtaggaaagcgtagcgtacggtacctaactttacttacttacgtactactactagtaacttaaccttaacctttaccaacgttagttacgtacttaccttaacccgttccggtaaccgaaacgggacctaaccgacgtaggtaaacgtaaacgttaaaccgtaacggtacggtcggtactacgaccgtaccttacgttcttcggttactttacccg

SEQ ID NO: 172675 - DNA, 641 bp, Homo sapiens
  misc_feature: GYAE6OF02HU3MM.27.78.H01.1.454.CMB.1.raw
  modified_base (151)..(151): a, c, t, g, unknown or other
  misc_feature (151)..(151): n is a, c, g, or t
  modified_base (455)..(455): a, c, t, g, unknown or other
  misc_feature (455)..(455): n is a, c, g, or t
  modified_base (545)..(545): a, c, t, g, unknown or other
  misc_feature (545)..(545): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtgaattgngctgactcagtctccagactttcagtctgtgactccaaaggagaaacgtcaccataccacctggccgggccagtcagagtcgttaggtagtagccttaacacgtcggtaaccagccagaacgccgtaggtcagttccgtaccaaaggtcctcctacatacaagtactcgcctttcccacgttcccttcgtacggtaccgggtcccctaggtaggttccgaggtcggccgtagtcggtatcggtcgggacctatacgtttccaaccctaccacctaactacctaagtaccgtccgtaggtaaccncgtaggaagtgtacgcgtttacgacttaacttaacttacgtatcctatcgtaacggtacttaacctttacctttaaccgtactagttacncgttacctacccgttcgacgaacggacctacgacgtagaacggtaacgtaaacgtaggtcgtcgtacctgacctacgtcgtaccgtgttcctaacg

SEQ ID NO: 172676 - DNA, 851 bp, Homo sapiens
  misc_feature: GYAE6OF02F8W23.27.78.H01.1.454.CMB.1.raw
  modified_base (147)..(147): a, c, t, g, unknown or other
  misc_feature (147)..(147): n is a, c, g, or t
  modified_base (325)..(325): a, c, t, g, unknown or other
  misc_feature (325)..(325): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtcctccgagtacctttcagtctgtgactccgaaaggacgaaagtcaccatccaccgtggcccgggaccacgtcagagtcggttaggagtacgtcttaacgactcgggtaccagcgaaggaacgccgtaaggtcacgttcctacccgaaagtcccttcctanattaccgaaaggttctacggtaccttaccccgtacgttacccctttccgtacccgggtacccggggtttccccctacgggttacgggtttccgtaaggttcggggtaccgtaggtacgggtacgttccgggtaacgggtaacctacccgttattttaccccgaaccccttacgaaccccgtaacttaccgtaaacgtttaccgggtacccgtaagggtaaccggtaccgttaagggaaaacgttgtaccggtactaacgttaaccttaaaccgttttacgttaacgttcgtaacctacgttacggtaacgtttaacgtttaaccccttttaaccgtttaacccgttgttaaaacgggttccttaacgttcccgttaaccccggttaaccggggtaaccgtaaacggggacccgtaacggtacggttaagtaaaccggttaaacgttaaaaccggtcggttaccgggttacgtaccgttaccgtaccgttaaccgttacttaccggtttaccgttaccttaacccgg

SEQ ID NO: 172677 - DNA, 713 bp, Homo sapiens
  misc_feature: GYAE6OF02H17SA.27.78.H01.1.454.CMB.1.raw
  modified_base (147)..(147): a, c, t, g, unknown or other
  misc_feature (147)..(147): n is a, c, g, or t
  modified_base (237)..(237): a, c, t, g, unknown or other
  misc_feature (237)..(237): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctctgggtcagcctccgaggggtanaaattgtgctgactcagtctccagtactttcagtctgtcgactacgaaaggagaaacgtcaccatccaccgtcggccggaccagtcgagnggtcggtttaggtagtagtaccttaacgacgtacggtaaccgagacgagaacgccgaggtctacggtcctaccaaacgtccttcctactaataccaaagttattcggcctttacccgaccgtttccttccgtaccgggtcccgggttcccccgttggtacggttcggacggtcgacgtaggtagtacgtacggtaggacctactacgttccaccctaccgacctacgtactaacgtacggtacctagggaacgtcgtaaggtaactagtacgtaccgtacgtaaacttaacggtttacttaccgttacgtactacgtacgttaacgtaactttaccttttaaccttaacgttaaccgtaggttaccctaacgtcccgttaccgttacgggaacgtaacggactacgtaggacgtaacgtaactaacgttagtcgtacgaccgttccgactaccgtaccttcgtcgttacccttacg

SEQ ID NO: 172678 - DNA, 675 bp, Homo sapiens
  misc_feature: GYAE6OF02FL5EG.27.78.H01.1.454.CMB.1.raw
  modified_base (179)..(179): a, c, t, g, unknown or other
  misc_feature (179)..(179): n is a, c, g, or t
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccgaggggtnaaattgtgctgactcagtctccagtactttcagtctgtgactaccaaaggtanaaagtcaccatccaccgtcggccggaccagtcgagacgtcgttaggtagtacgtcttaaccacgttaggtaacccagtacgaaggaacgccgaggtccagtacctaccgaaagtcctccgtacactacgaagttctcgtacctttcccagttcccttacgtccgtaccggggttcccctacggtacggttacacggtcggctagggtgtacttcggtacggacctaacgtactttacccgacccttacaaccgtactacaacgtaccgcgtaggaactcgtaagaagtacgtcgactacgaccttaacgttacttacgtcgtactaacgttaccgagttaacgttacctttaaccgttaccgaataacggttcgaaccttccgtaaccgttacgggaacccgtaacggaccgtaacgaccggtaggtaacgtaagttaaaccg

SEQ ID NO: 172679 - DNA, 707 bp, Homo sapiens
  misc_feature: GYAE6OF02FQPLM.27.78.H01.1.454.CMB.1.raw
  modified_base (476)..(476): a, c, t, g, unknown or other
  misc_feature (476)..(476): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaagggagaaagtccaacctatccacccgtcggcccgggcctaggtcaagacggtcggttaggtagtacgtcgttaccagttcggtaaccagaccgaagaacgccgaggtcagttcacccaacgtcctcctacattccgaagttactcgtaccttcccgtacttccgttccgtccggtaccgggtccccgtaggtacggtttcgaggttcggcgtagtggacgtacgtaggcacgttacttcccaccctacgtaccaacgtacaactacgaccgtgggtaaacncgttaaggaacgtgtacgtacgttacgtacgttaaacctttagtacgttcgtactacgtaccgtagttaccgttaacctttaccgtttacgtaacgttagtccgttacgtacccgtaaccgttccgggaacgtaaccggaaccgtaccggtagtacgggtaacgttaacttaaccggacgtggtaacgtcgtacgaccttaaccgtacgtttccgttacgttacccgtccg

SEQ ID NO: 172680 - DNA, 576 bp, Homo sapiens
  misc_feature: GYAE6OF02FJIUC.27.78.H01.1.454.CMB.1.raw
  modified_base (286)..(286): a, c, t, g, unknown or other
  misc_feature (286)..(286): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaattgtgctgactcagtctccagactttcagtctgtgactccaaaggagaaagtcaaccatccacctggcccgggccagtcagagccggttagggtagtagccttacagtcggtaccagcagaacgccgaggtcagtcnccaaagcctcctcatccaagtatcgccttcccacgtccttctcgaccggggttcccctcgtacggttcgagtgggcaggtcggagtcgtgggacactattccacctcaccatacaatgcctaggaatctagaagatgctcgacctaacttacttactgtctatcgaagtacgttaaccttactttacctacctagtacgtactaccgtaccttaccggacgaacggaccacgtacgtaggagtaacgtaaacgactggtacgacgtcgacgacctatcgttcgtcttacc

SEQ ID NO: 172681 - DNA, 603 bp, Homo sapiens
  misc_feature: GYAE6OF02GGQFY.27.78.H01.1.454.CMB.1.raw
  modified_base (150)..(150): a, c, t, g, unknown or other
  misc_feature (150)..(150): n is a, c, g, or t
  modified_base (200)..(200): a, c, t, g, unknown or other
  misc_feature (200)..(200): n is a, c, g, or t
  modified_base (460)..(460): a, c, t, g, unknown or other
  misc_feature (460)..(460): n is a, c, g, or t
  modified_base (499)..(499): a, c, t, g, unknown or other
  misc_feature (499)..(499): n is a, c, g, or t
tcagagcgtcgtctcacgaccggtgctcgatttagtgtgagtagtttgggtttggggggcatgagcaaaactgacaagtcaagggcaggaagatgttgccatcacaactcattgggtttctgctgctctgggttccagcctccaggggtnaaattgtgctgactcagtctccagactttcagtctgtgactccaaagganaaagtcaccatcacctgccgggccagtcagagtcgttggtagtagcttacacttcggtaccagccagaacgccaggtacagtcctaccaagtcctcctacactcaagtactcggtccttcccgacgttccttcgtcgaccggggtcccctcggaggttcaggtcggacgagtggatcggtgggactacgtactttccacccttcgacctactacaatacgccgtaggagcgtagaagtactgctgactaacttattacgngtactactacgtagtacgttaccttaactttacccgtanaacgttgaccttaccgaccttacggaccgaagggacctacggaccgtaggacgtaaacttaacgaaccgtggtacggactcggtacctcgtattacctgttacc

SEQ ID NO: 172682 - DNA, 712 bp, Homo sapiens
  misc_feature: GYAE6OF02GP1FB.27.78.H01.1.454.CMB.1.raw
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtgactacaaaggagaaagtcaccatcaccgtgccggacagtcagagtcgttggtagtagtctacactggtaccagacaaggaacgccgaggtcacgtcctaccgaaagcctacctcactacgaagtactcgtcctttacccctagttcccttaccgtcggtaccgggggttccccctacgggtacggtttccgtaaggtcggacgtaggtacggtacgttacggtacgggaactaccgtagtttacccacccttaccaccctaactacgaaacgttacggtaccgtagggtaaccgtcgtacgtaacgtagtacgtaccgtagtaccttaacgtttaacttacgttagttacctaagttaccgtaacgttaacgttaacctttaaccgtttaccttaacgtaaggttcgtaaccttaccgtacccggttaccggaacccgtaaacgggtaccgtaaccggtacggtaacgggtaacggtaactttaaaacccggg

SEQ ID NO: 172683 - DNA, 717 bp, Homo sapiens
  misc_feature: GYAE6OF02H85IM.27.78.H01.1.454.CMB.1.raw
  modified_base (292)..(292): a, c, t, g, unknown or other
  misc_feature (292)..(292): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatcacctcgccgggccagtcagagcggttggtagtagcttacgactggtaccagcagaagccaggtcagtctacaaacgctcctanatacaagtactacgtccttcccagttccttaccgtccgtacggggtcccctacggtacggttcgtacggtggacgtacggtaggtacgtcgtacgggactactactttaccgtacccctacaacccgtactacaaatacgtaccgttacggaacgtactacggtaaagtagttaccgactacgtaacttaacctttaagttaccttacgttactaacttacgtaaacggtactttaaaccttttaaacccgtttaccgttaaccttaaggtcctaacgttacccttaacccgtttacccgggaaccggtaaaacgggtaccgtaaaccggtacggtttaacgggaaagttaaaccgtttaaaccggaacgttacggtacggaccgttcgacctaaccgtaactttccggttacttaccctttacc

SEQ ID NO: 172684 - DNA, 778 bp, Homo sapiens
  misc_feature: GYAE6OF02JHPSY.27.78.H01.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaattggtgctgactcagtcctccagtacctttcagtctgtgactaccaaagganaaagtcaccatcacctgccggcagtcagcgcgttggagtagcttaacacgtggaccagcaaggaacgccgaggtcagtctaccgaaagcctcctacatacaagtntacgccttcccagttccttcncgtacgggtcccctgagttcagtcgcagtgactgtaggactctattcccgacctacctaacgactaccgtaaacgtacgacccggtaaggaaccggtacgtaaggtaaacgtaacttcggtaccgttacggtaaaccttaaaccgtttttacgttaacccgttacgggtttaaccaaccgtttaacggtaaaccgggtttaaactttaaaccctttaaacccgttttttaacccgaacggttttaaacggtaccggtttaaccgttacccggtttaaacccggtttaccggggaaaccccggttaaacggggaaccttaaccgggtaccgggttaacggggtaaacgttaaaccggtttaaaaccggtaccggtttacgggtaaccgggttaccgttaacggaacccgttaaccgtacccggtttacggtttacccgttcggtttaacccc

SEQ ID NO: 172685 - DNA, 794 bp, Homo sapiens
  misc_feature: GYAE6OF02H28W6.27.78.H01.1.454.CMB.1.raw
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctcgtggttccagcctcgagggtnaaattgngctgactcagtcctccagtactttcagttctgtcgactacgaaaggtacgaacgtcaccatccgacctcggccggacagtcgagtaggtcgtttaggtagtactcttaccgcttggtaaccagacaacgaacgccgtaaggtcacgttcctaaccaacgtcctcctatactaccgtaaagttcgtcgtcccttacccgtcgttccccttacgtccggttacccgggtccccttggtacgttacgtgtacggctagggtacgtcgtacggttacggacctaaccgtttactcccgtaccccttaacgaaccctataacctaacgtaccgtacggttaacggacctacggtagtaaccggttagtccggtaaccgttaccgttaaacgtttacttttacgttaaccgttcgttacttaaccgtacggtaactttaccgtttaaacccttttacccgtttaacctaacgtttacgtaaccgtacccgtttaaccgcccccgggtttaaaggaaccccggtaaagggacccgtaccgggtaacgttaacgggtaaaccggttaaaccttaaccgggtcgtttaaccgggccgttacgtaccgttaaccccggtaactttccgtttacccgttccgttaaccccg

SEQ ID NO: 172686 - DNA, 690 bp, Homo sapiens
  misc_feature: GYAE6OF02GI5WM.27.78.H01.1.454.CMB.1.raw
  modified_base (145)..(145): a, c, t, g, unknown or other
  misc_feature (145)..(145): n is a, c, g, or t
  modified_base (281)..(281): a, c, t, g, unknown or other
  misc_feature (281)..(281): n is a, c, g, or t
tcagagcgtcgtctcacgaccggtgctcgatttagtgtgagtagtttgggtttggggatgagcaaaactgacaagtcaaggcaggagatgttgccatcacaactcattgggtttctgctgctctgggttccagcctccaggggtnaaattgtgctgactcagtctccagactttcagtctgtgactcaaaggagaaagtcaccatcacctgccggcagtcagagcgttggtatagcttacactggtaccagcagaagccaggtcagtctccaaagctcctnatcaagtatgccttcccagtccttctccgacggggttcccctgtaggtttcaggtcgcaggtggatcgtgggacactatttccacctcaccatacaatacgccgtaggaacgtctagaacggtatcggcgtacgtacgtaaaccttttacttaccttggtactaacgttaccgtaacgttaacgtttaacccgtttaacctttttaacccgtacgttaaacggttcgttaaacgtttaccccgttaacccgggtttaccgggaccccggttaaaaggggacccgaaccgggtaacggttacgggtaaacggttaaaacggtttaaaaccggttaaccgttacggggtttacgggaacctttaccgggacctaacccgtaatttcccgttaccggttcttttaaccccgg

SEQ ID NO: 172687 - DNA, 871 bp, Homo sapiens
  misc_feature: GYAE6OF02GDYN0.27.78.H01.1.454.CMB.1.raw
tcagagcgtcgtctcacgaccggtgctcgatttagtgtgagtagtttgggtttggggatcttaaaagaggttcttctctgggatgtggcatgagcaaaactgacaagtcaaggcaggaagatgttgccatcacaactcattgggttctgctgctctggttccagcctctagggttaaattcgtgctcgactcgtacgtcctaccgtaagtaccttcgacgttcgtgtcgtacctaacgaaagggaacgtaaacgtaccaaccgtactacctacccggtcgggaccccgggtacctaacggttacgaacggacggttaccggttttagggtaacgttaacggttaccttaaccgtaccggtttaccgggaacctaacggacggtaaacggtaccgtaaccgggtacgggttaccgaccgttacccgtaaaccgtaaccggtccccttaccgtacaaccgtaacgtaacgttcgtacccgttaccttacccgtaccgttccgttaccgtaccggtacccgggttccccgtagggttacggtcgtaggtcgacgtacgggtacgttacgtcggttacgggaacctacgttttaacccgtaccccgtaccccgtaacacccgtttaacgacgttaaccgtacggtaaccggttacggaacggttaccgtaagaacgttcgtacggtaccgtaacgtaacccttttaggttaccttacgtcgtaacttaccgtacgttaaagttacccggtttaactttacccgttacgtaaccgtcgtttaaccggaccttacccggttaacggacccgtaaaccgggacggttaacccacgggttaaccggtacgtaaaccgggttaaacttaaccccgggtag

SEQ ID NO: 172688 - DNA, 726 bp, Homo sapiens
  misc_feature: GYAE6OF02ID5LK.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgtaaattgtgctgactcagtctccagtactttcagtctgtcgactaccgaaagganaaagtccaccatcacctcggccgggccaggtacagacgtcgttaggtagtagtcttacacgttacggtaacctagaccaagaacgaccgaggtcacgtcctaccaagcctcctcatacgtaagtactcgtccttcccgtacgttccgttcctaccggtaccgggttccccgtcggtacggttaccgtaggttcggacgtaggtcgtagtcggtagggtacctacgttacttacccgtaccctacctaaccgtactaacgtaacttaccgtaccgtaggaacggtacgttaaggtaagtacgtacgtaccgtacgttaaccgttaactttactttacgtacgttactacgttacgtaacgttaacgttaaaccctttactttaaccgttaacgtacgttaactacgttaacccgttacccgttaccggaacggtaacgtaaccgtacgtacgtaacggtaacgtaaacgttaaccgtacgtacgtacgtaccgtacgacctacgtacttcgttacctccgttacc

SEQ ID NO: 172689 - DNA, 672 bp, Homo sapiens
  misc_feature: GYAE6OF02HHLEO.27.78.H01.1.454.CMB.1.raw
  modified_base (183)..(183): a, c, t, g, unknown or other
  misc_feature (183)..(183): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctggttccagcctcgagggttaattgngctgactcagtctcgagtcttcagtctgtgactaccaaaggagaaacgtcacactacaccgtggcccggcacgtacgagacgtcgttaggtagtagtaccttacgtacgtacggtaccagacgaacgacgaccgaggtaccgtacgtaccgtaccaaacgtccttacctcgactactaaagttctcgtaccttcccgacgttccctttaccgccggtaccgggttccccgtggtacggttcgtaggtacggacgtagtcggagtccgtacgggactacgtacgttccaccctaacgcctactacgtaacgtaccgaccgtaggtaacctagtagtaacgcgtgtaccgtagttacctaaacgtttaaccgtctacgtactaacgtactaacggttacttaaccgttacttaaccgtagtacggtacgtacttaccgacggttaccgaccggaagtaccgacggtacgtaggaacttacgtaagtaccgg

SEQ ID NO: 172690 - DNA, 686 bp, Homo sapiens
  misc_feature: GYAE6OF02FXWHS.27.78.H01.1.454.CMB.1.raw
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaaattgtgctgactcagtctccagtactttcagtctgtcgactaccgaaagganaagtcaccatcactcggccggcagtacagacgcggttggtagtagtcttacacgtgtaccagcaagacgccgagtcagtcacaacgctccnctatcgagtntcgtcctcctacgttcctcgtccgtaccgggtcccctcggtacggttacgacggtcggacgtaggtacggtactccggtacgggactaccgttacctttacccgaccccgttacctaaccctaataccgtaaacgtccgaccgttacgggtaacgtcgtaaggtaacgtacgtcgtacgtacaccgttaaactttaccgttacgttcggtactaacgtcgtaacgtacgttaaccttaaccgttacctacgtaagttacctacttaaccgtacccgtacggaccgtaacggtaacgaccggtaacgtacgggtaaacgtaaccgtaaacggtacgttacggtacgtacgtacctaccgtactaccgttctccgtttacccg

SEQ ID NO: 172691 - DNA, 819 bp, Homo sapiens
  misc_feature: GYAE6OF02F2D92.27.78.H01.1.454.CMB.1.raw
  modified_base (178)..(178): a, c, t, g, unknown or other
  misc_feature (178)..(178): n is a, c, g, or t
  modified_base (198)..(198): a, c, t, g, unknown or other
  misc_feature (198)..(198): n is a, c, g, or t
tcagagcgtcgtctcacgaccggtgctcgatttagtgtgagtagtttgggtttggggatggagcaaaactgacaagtcaaggcaggaagatgttgccatcacaactcattgggtttctgctgctctgggttccagcctccgagggtgaaattgtgctgactcagtctccagacctttnagtctgtgactacaaagganaagtcaccatcacctgccgggcagtccagtacgcgttaggtagtacgcttacacgttggtaccagacaagaacgcctaggtcagtcctaccgaagtctcctacatcaagtctcgtccttacccgtacgttcccttcgtccgtaccggggttaccctacggtacggttccgaggttggaccgtaggtgggtacttacggtacggaacctaccgttactttacccacccgttacgtaacccctaatacccgtaaacgtacggtacccgtacggtaaacgtaccgttaagggaaacgtaccgtttggtaacccttaacggttacccgttaaacgttttaacccgtttacgttacgttaacccggtacgttaaaccgtagggttaaaccttttacccttaaccggttttaaaccaacgggttaaccgttaggtaacccctttaccggttaacccgggtaacccggtaccgggtaaaaccgggaacccgttaacgggtccgtaaacgggttaaccgttaaacgggttaaaacccgttacggtttaccgggtacggttaacccggttaccgtacccgtaaacccgtttaccggtttacccggtttacctttaccccgtttaacccgg

SEQ ID NO: 172692 - DNA, 526 bp, Homo sapiens
  misc_feature: GYAE6OF02HSZR2.27.78.H01.1.454.CMB.1.raw
  modified_base (346)..(346): a, c, t, g, unknown or other
  misc_feature (346)..(346): n is a, c, g, or t
  modified_base (442)..(442): a, c, t, g, unknown or other
  misc_feature (442)..(442): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggagtagcttacactggtaccagcagaagccaggtcagtctccaaagctcctcatcaagtatgcttcccagtccttctcgacggggtcccctgaggttcagtggcagtgatcngggacactatttcacctcaccatcaatagcctggaagctagaagatgctgactaacttatactgtcatcaagacttaacttactttaccataagtntatctaccttcggaccaaagggacacggactaggaagtaacgtaaaccgtaactggtgactgacctacctagtcctgtcttacc

SEQ ID NO: 172693 - DNA, 998 bp, Homo sapiens
  misc_feature: GYAE6OF02IYUT4.27.78.H01.1.454.CMB.1.raw
  modified_base (368)..(368): a, c, t, g, unknown or other
  misc_feature (368)..(368): n is a, c, g, or t
tcagagcgtcgtctcacgaccggtgctcgatttagtgtgagtagtttgggtttggggagtgagcaaaactgacgaagtcaaggcaggaagatgttcgccatcacaactcattgggtttctgctgcttcgtcgggttccagccttccgaggggtagaaagttgtgcgtggactcagtactaccagtactttcgagtctagtacgactaccaaagggtacgaaaacgttcaacctacgtccgaaccgtggcccgggccacggttccaagacggtcggttagggtaacggtaacgtcttaaccgtacggttacggtaccaggacaaggaaccgacgtaggtccagttacctaccgaaacgtcctccgttanaacgtacgtaaggtacttacggtaccttaccgtacgttaccttcgtccgggtaccgggttcccgtacggttacgggttacgacgggttcggtaccgtaggtacgggtagttccgggacgggtaactaccgttaacgtttacccgacccgtttaccaaccgttactaaccgttaaccgccgtttaaccggtacggtaacggtaccgttaacggtaacggtacgttacggttccggttaacggtaaacccctttaacgtttaacgttttaccggttaccgtaccgttaaaccggttaccgtaaacgggtttaacccgtttaaacccgttttacccgtttaaaccccgggtaagttaaaccggttacccggttaacccgggttaaccccgttaaccccggggtttaacccgggtaaacccgggaaacccgggttaaacccggggtaaccgttttaaccggggttaaccggggtttaaaccggttaaaacccggttttaaaacccgggtaaacggggtttacccggggttaacccgggttaacccggttaaacccgggggttaaacccttaaaaccccggtttcccgggtttaacccccgttttttacggggtttaacccccttttaaccccgg

SEQ ID NO: 172694 - DNA, 736 bp, Homo sapiens
  misc_feature: GYAE6OF02JJ04S.27.78.H01.1.454.CMB.1.raw
  modified_base (282)..(282): a, c, t, g, unknown or other
  misc_feature (282)..(282): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgacctaccaaaggagaaagtcaccatcacctcggccggccagtcagagcgttggtagtagcttacnctggtaccagcagaacgccaggtcagtctaccaaagcctcctacatacaagtactcgcttcccacgttccttcgtaccgtacggggtcccctggtacggttcaggtcggacgtaggtcggtactcggtcggggaacctacgttactttacccgaacccctaccgtaaccctacttactaaacgttacggacccgttaagggtaaccgtaccgtaacggaaagtagttccgtaaccgttacggtaacttaaccttttaagtttaccgtttacggttaccttaacgttaccgtaaacggttaaccgttttaacctttaaacccgtttttacccgtaaccgtaacggtttactaaaccgtttacccgttaacccgttaacccgggtaacccgtaaacggggtacccgtaaaccggttaacggttacgggtaaacgttaaaccgtttaaaaacccggg

SEQ ID NO: 172695 - DNA, 707 bp, Homo sapiens
  misc_feature: GYAE6OF02GC2ST.27.78.H01.1.454.CMB.1.raw
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
  modified_base (574)..(574): a, c, t, g, unknown or other
  misc_feature (574)..(574): n is a, c, g, or t
  modified_base (659)..(659): a, c, t, g, unknown or other
  misc_feature (659)..(659): n is a, c, g, or t
tcagagcgtcgtctcacgaccggtgctcgatttagtgtgagtagtttgggtttggggggcatgagcaaaactgacaagtcaaggcaggaagatgttgccatcacaactcagttggtttctgctgctctgggttccagcctccgaggggtnaaattgngctgactcgagtctccaagtactttcagtcctgtacgactaccgaaaaggtagaaacgtcaaccagtccaccgtcggccggaccagtacgagacgtcgttaggtaagtacgtaccttacgaccgttcggtaaccngtacaagaaccgcctaggtacacgtacctaaccaagtcctaccgtanaactaccgaaagttcaccgttaccctacccgtaacggtttcccttacgtacgggtaccccggttccctagggtacgttacaggttcggactaggtcgtaacgtcgtacggactaccgtcttaccaccctacaacgactacaaacgtcgaccgtagaactgagaacgtncgactnaaccgtaatttacgtacgtntaacgtacgtacgaacgttaccttaacgttaccttaaccgngtaaaccgttcgtaacgtttaccccgtacgacggtaaccgaacggttccaacggttcggaaggtaaacgtaacttaaaccgggtnacccggttagtacctacgtacctaacgttcttaccgttacggttaccc

SEQ ID NO: 172696 - DNA, 713 bp, Homo sapiens
  misc_feature: GYAE6OF02GJSIM.27.78.H01.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttcagcctccagggtgaaattgtagctgactcagtctccagtactttcagtctgtgactccaaagganaaagtcacatcacctgccggcagtcagagcgttggtacgtagtcttaacacgtacggtaccagtacgaacgaagccgtaaggtctacgtacttaccaaagtccttcctacataccaagttactcgtccttacccagtttccttccgacggtaccgggtcccctacggtagttaccgaagtcggacgtaggtacgtctcgtcggaacaccgttactttaccaccctgtaacctatacaacgttacgaccgttagggaacgtacgtagaaaccgtatacggtcgtacgtaccttaaactttacgttaaccgtgtttaaccacgttgaaaccgttacgtttaaacctttaacccttaccgtactaaaccgttcgtaattaccccgtaacgtcccggtaaacgtaaccgtacgtaccgtacgtacgggtaaccgtaaacgttaaccggtaaaggtacccggtttcggaaccgttaccggtacccaaaccttacgggttacttacccggttagtttaaccccg

SEQ ID NO: 172697 - DNA, 674 bp, Homo sapiens
  misc_feature: GYAE6OF02FQYUY.27.78.H01.1.454.CMB.1.raw
  modified_base (230)..(230): a, c, t, g, unknown or other
  misc_feature (230)..(230): n is a, c, g, or t
  modified_base (354)..(354): a, c, t, g, unknown or other
  misc_feature (354)..(354): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctctgggttccagcctccgaggggtgaaattgtgctgactcagtctccagactttcagtctgtgactacaagganaagcacatcactcgccggccagtcagagcgttggtagtagctttaacacgtggtaccagactaagaagcccgaggtcagtcctacaaagtctacctcatcaagtatcgtcctccgagtccttcncgtacgggtccctcggtacgttcgagtggcgtaggtgtaacgtcgtcgggtacacgtactttaccgaaccctcaccctaagtacctaaacgtcgtaccgtagggaaacgtcgtacgtaacgagtacgaccgttacgtactaaacgtttacttacccgttagtaacgtacgtacttaaacgtaaccgttaacctttaaaccgtttaccccgttaaagtaaccgggttcttaaccgttacccttaacccggtttacccgggaaccgtaaacgggaccttaaccggtaacggtaaccggtaaacgttaacgttaaaaacccgg

SEQ ID NO: 172698 - DNA, 716 bp, Homo sapiens
  misc_feature: GYAE6OF02FLTSL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggagaaagtcaccatcacctgccgggcagtcagagcgttggtagtagcttacactggtaccagcagaagccaggtcagtctcaaagctcctcatcaagtatcgtcttcccagttccttctccgacggggttcccctcggaggtttcgaggtggaccaggttggacttcgtcggggtactaccgtagttttacccaccccttaccaaccctaatacctaaacgtacgacccgttagggaacgtcgtaaggaaagtatacggtccgttacggtacttaaacttagttaccgtttaggtacctaagttaccgaacgttaacgtttaaccgtttaacccttttaccgttaacgtaaaggtttacgtaaaccttaccgttaacccggttaccgggtaacccggtaaaacgggggtaccctaaccgggtacgttaacgggaacgtaaaacgtttaaaccggtacgttacggttacggtaccgttacggacccgtaaccgtaccgtttaccgttaggtttacccttaacccg

SEQ ID NO: 172699 - DNA, 710 bp, Homo sapiens
  misc_feature: GYAE6OF02FI9F1.27.78.H01.1.454.CMB.1.raw
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (376)..(376): a, c, t, g, unknown or other
  misc_feature (376)..(376): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctcaggggtnaattgtgctgactcagtcctccagactttcagtctgtagacctccgaaaaggganaaacgtccaccatccaaccgtcggcccgggccagtacagcgcgttggtagtagtcttacacgtggtaccagcagaacgccgaggtcagtctaccaaagcctacctacatactaagtactcgtccctttccacgttccctttacnccgggtaccgggtccccgtaggtacgtttcgagtcggcgtaggtcggtactcggtacgggtactacctacgtttaccaccctaccaccgactacctaataccgccgtaaggacgtacgtagtaagtacgtacggacttaccgtaacgttaactttacgtttaacgtacgttacctaacgttacctaacggttaacgttaacccgttttaaccgtttaaccttacggtaacggttaacgtaccttaacccgttaacccgttacccgggaacccggtaaaccgggtaccggtaacccgttaccgggtaacggtaaggttaacccgttaaaaccggg

SEQ ID NO: 172700 - DNA, 857 bp, Homo sapiens
  misc_feature: GYAE6OF02IT9S0.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcagttgggtttctgctgctcgtgggttccagcctccgaggggtagtaaattgtgctagtacctcagtctaccagtactttcgagttctggtcgactaccgaaaggaagaaacgtccaaccactccaccgtcggacccgggaccagtcgaggtacggtcggttggtaacggtacgtaccttaaccgtacgttacgggtaccgaacggacgaacggaaacggacccgtaagggttacctaacggttaccctaaccggtaaaacctcccttacccgtactaacgtaacgtaaacgttacgtcgtaccccctttacccgtaccgtttacccgtttaccgtacccggggtaaccccgggggttacccccttacgggttaacgggtttaccgaacggttcgggacggttaaggttccggggtaaacttccgggtacggggtaacccttaacgtttacctttaccccgtaacccccgtactaacccgttaacgtaaaccgtaaacgttccggtaacccggtaacgggtaacggtaaccgttaaggaaacggtagtccgtacgttaacgtaacctttaccgtttaacttacgttactaacacgttacgtaacgtaaccgtttaccttaacgttacctaacgtacgtacttacctaccgttaccgtaccggtaccggaaacgtacgtaccggtacgtacggtaacgtaacgtaacgtgtacgtacgtactacgtaccacgttactcggttacttcgtaccg

SEQ ID NO: 172701 - DNA, 705 bp, Homo sapiens
  misc_feature: GYAE6OF02JVS7V.27.78.H01.1.454.CMB.1.raw
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
  modified_base (312)..(312): a, c, t, g, unknown or other
  misc_feature (312)..(312): n is a, c, g, or t
  modified_base (672)..(672): a, c, t, g, unknown or other
  misc_feature (672)..(672): n is a, c, g, or t
  modified_base (691)..(691): a, c, t, g, unknown or other
  misc_feature (691)..(691): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggttctgctgctctgggttccagcctcaggggtnaaattgngctgactcagtctccagtacctttcagtctgtgactaccgaaagggactaagtcaccatccaccgtcgccgggccagtcgaagcggtcgttaggtagtacgcttacgacgtcgtaccagacgagaacgccgagtaccagtcctaccgaagtcctactntactaccgaagttagtccgtacctcccgtaccggttccctgtaccccggtaccggggttcccctcggtaacgttcgacggtcggcgtacggtcgtagtccgtacgggtacaccgttactttcccgaacccgttacaaccttactaccgtaaacgtacgacccggtaggtaaacgtccgttaagaaacgtacgtgtacgtacgtaccgtaaatttacgttacgtactacgtaacgtacgtaaggtaaccgtttaactttaaccgttaaccgttacgtaacgtacgttacctaaccgttaacccggtacgtaaccgaaacgggtccaagtacgtggtaaactaacgtaaacgtactaccggnttaccgacgtaccctaacncgttactccgtacg

SEQ ID NO: 172702 - DNA, 728 bp, Homo sapiens
  misc_feature: GYAE6OF02I8SYL.27.78.H01.1.454.CMB.1.raw
  modified_base (148)..(148): a, c, t, g, unknown or other
  misc_feature (148)..(148): n is a, c, g, or t
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (504)..(504): a, c, t, g, unknown or other
  misc_feature (504)..(504): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgcctgctctgggttccagcctccgaggggtnaaattgtgctgactcagtcctccagtactttcagtctgtagactaccgaaagganaaagtcaaccataccaccgtgcccgggacctagtccgaagacgtcggtttacggtagtacgccttaanaccgtacggtaccacgcgaaacgtaacggccgtaaggtctacgtcctaaccgaaacgccttcctacgatacgaacgttacttcgtacccttacccgaccgttcccgttcgtaccggtacccgggttcccctagtacgggtacctaggtcggacctaggttacggaccttcgggtaggacctacgttacttcccacccgtcaaccctagttacaacgttaccgacgtgaacgtntaagaacgtagtcgtacgtaccagttaaccgtattacccgtagtccattacgtaacgtacgtttaaccttaccgttaactacgtagtaccttacgtaacccgtacgttaccggaacgtaaccgtaacgtccggtacgtaaggtaaaccgtaacgttaaaccggtacgttacggtacgtaccgtaccgtacccgtaactcggtttaaccgttccgttacctaccg

SEQ ID NO: 172703 - DNA, 754 bp, Homo sapiens
  misc_feature: GYAE6OF02JN1W8.27.78.H01.1.454.CMB.1.raw
tcagagcgtcgtctcacgaccggtgctcgatttagtgtgagtagtttgggtttggggatcttaaagaggttctttctctgggatgtggcatgagcaaaactgacaagtcaaggcaggaagatgttgccatcacaactcattgggtttctgctgctcgtgggttaccagcctccgaggggtgaaattgtgctgactcagttctccagtactttcagtctgtgacctaccaaaggagaaacgtccaccatccaccgtcggccgggaccagtcagagtcgttaggagtacgcttacacgttcggtaaccagacgaagaacgccaggtcagttcccgaacaacgccttccctataactactaagtactccgtaccttcccgtagttcccttacgtaccggaaccggggttcccctaggtacggttcgacggtcggtaccgtagggttagtacgtttaccggtacggggtaacctacgttacgtttaccccaccccgttcctaaacctaactacgtaaacgttaccgtacgtacgggtaaacgttacgtacggaacgtacgtcgtcctacgtaaccttaacgtttacgttactacggttacctaacttacggaacgttaaccgttaacccttttaccgtttaaccttaccggttaaacggtcgttaaccgttaccccgttaacccgttaccggtaaacccggtaacgggtaccctaacggttaccgggttaacggtaaccgttaaacggttaaacccgg

SEQ ID NO: 172704 - DNA, 841 bp, Homo sapiens
  misc_feature: GYAE6OF02ISKKA.27.78.H01.1.454.CMB.1.raw
  modified_base (155)..(155): a, c, t, g, unknown or other
  misc_feature (155)..(155): n is a, c, g, or t
  modified_base (188)..(188): a, c, t, g, unknown or other
  misc_feature (188)..(188): n is a, c, g, or t
  modified_base (781)..(781): a, c, t, g, unknown or other
  misc_feature (781)..(781): n is a, c, g, or t
tcagagcgtcgtctcacgaccggtgctcgatttagtgtgagtagtttgggtttggggatgagcaaaactgacaagtcaaggcaggaagatgttgccatcaacaactcagttgggtttctgctgctcgtggtcacgcctccgagggtagaattgtnctgactcagtcctaccagtactttcagtctgtnactacgaaaggagtaaacgtccaaccactccgaccgtggcccggaccagtacgagacggttcggttaggtaagtacgtaccgttaacgaaccggttccggtaaccagacgaaacggaccgaccgtacggtactaacgtacctaaccgaaacgtcctacctacgtaacgtaacgtaagttacgtacgtccctttacccgtacgtttcccttaccggtaccggtacccggggttacccccgtacggttacggttacggtacggtacggtcgtaacggtcggtacgtacgtaccgggaacctaacggtttacttacccgaccccgtaacgtaaccctaacgtaccgtaaagtaccgtaaccggtacggtaacgtaaccgtaagaacgtaacgtcgtaacgttaccgtaacctttaaacgtttacgttaaccgttacgtacgtaacgttacgtaaacggttacttaaacccgttttaaccgttacgttaacgtaacgtacgttaaccgtacccgttaacccggttaccggaaaccggtaaaccggaacccgtaacggttaccggtaaacggtaaaccggtaaacgtttaaaccgggnggttaacggccggtactttaccgaccgttaccgtaacgttccgttagttccccgttaacc

SEQ ID NO: 172705 - DNA, 721 bp, Homo sapiens
  misc_feature: GYAE6OF02HKC21.27.78.H01.1.454.CMB.1.raw
  modified_base (146)..(146): a, c, t, g, unknown or other
  misc_feature (146)..(146): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaattgtgctgactcagtctccagtactttcagtctgtgactacgaaaggagaaagtcaccatcaccgtgccgggcagtcagagcgttaggtagtagcttacgacgtggtaccagcagaacgccaggtcagtcctacaaagcctacctcactacaagttactcgtccctttacccagtttcccctttcgtccggtacccgggggttcccccttacgggtaccggtttacgtacggtagggtacgaacggtttgggaacttcgggtacggggtaacctaaccgttacttttccccgaaccccttaccaaccctaagttaccaaagttacgtaccgtaggaacggtactaacggaaagacttgtactagaccttaaacgtttacgtttacttacgttacaacttacgtaaaggttaccttaacctttaccgtttacctacgtaaagttacgaaccttccgttaacccgtaccgggtaaccgaaacgggtaccgaaccggtacggttaaggaaccggtaaacgtaaaccgtaggtcgtacggtacgtcgaaccaccttacgttacttacgttaccttac

SEQ ID NO: 172706 - DNA, 754 bp, Homo sapiens
  misc_feature: GYAE6OF02IF87H.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctcgagggtgaattgtgctgactcagtctccagactttcagtctgtgactaccaaaggagaaagtcaccatcacctgccggcagtcagagtcgttaggtagtagtcttacacgtcggtaccagacaaggaacgccgtaggtcacgtctaccaaagtcctaccgtcatactaacgttacgtcgtccttacccgtacgttcccttacgtcgtaccggggtcccctagggtacggttacgaggtcgcgtacggtggacgttcgtacgggtacctacttaccgtttacccgacccttaccgtaacctaacgtaccgtaacgttaccggtaccgtaacgggtaaacgtaccgttaaggaaacgttacgtacggtaccgtttaacggtaaccctttaaacgtttaccgtttaacgttcgttaacttaccgttactaaacggttaacctttaaccgtttaaccgttttaccgttaccggttaagttacggttaaccgttacccggttaaccccggtttaccgggaaacccggtaaccgggtaacccgttaacggttaccggttaacggttaccgttaaacggttaaaacccgg

SEQ ID NO: 172707 - DNA, 658 bp, Homo sapiens
  misc_feature: GYAE6OF02IPPZ8.27.78.H01.1.454.CMB.1.raw
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccgaggggtgaaattgtgctgactcagtctccagtactttcagtctgtgactacaaaggagaaacgtcaccatccacctggccggccagtcagagtcgttggagtncttacacgtggaccagacagagccgagtcagtctcaaagctcctcatcaagtatgtccttccncgtaccttctcgtccgggtccctcggtacggttcaggtcggcaggtggacttcggcggganacctacgtttaccacccttaccaacactctaaatcgtcgtagggatactacggaatacgtgactacgtactaacttaagttaccgtagttaccagttacaacgttaacgtaccgtttaacctttaacctactaaaggttacaacttcccgtaaccgtttccgggaaccctaacgggaaccctacgggtaacggtacggaacggttaaaacgttaaacccggtaacgttacgggttaacgtccggtacgaacccgtaaccgtaccgtttcgtttacggtaccttttacccg

SEQ ID NO: 172708 - DNA, 655 bp, Homo sapiens
  misc_feature: GYAE6OF02HQ5ZH.27.78.H01.1.454.CMB.1.raw
tcagagcgtcgtctcacgaccggtgctcgatttagtgtgagtagtttgggtttggggggcgatgagcaaaactgacaagtcaaggcaggaagatgttgccatcacaactcattgggtttctgctgctctgggttccagcctccaggggtgaaattgtgctgactcagtctccagactttcagtctgtgactccgaaaaggagaaagtcaccatcacctgccgggccagtcagagcgttggtagtagcttaacactggtaccagcaagaagccaggtcagtctaccaaagctccctcataccgaaagttatggcctttaccccaggtttccccttcgtaccgaacggggttccccctacggtacggttccaaggtcggactaggtggactcgtggggaactactacgtttccaaccctcgaccatacaaatacgccgtaggaacgtactagaaagtagtacgacttaggaccttaaactttaagttaacctttgtacctatcaaagtacgttaacttaacctttaacctaacgtaacgttagtacttaccgttaccgtacggaccgtaaacgggacaaccggtacgtagggaactaaacgttaaacgaacgttcggtacggtactacgacctaaccctacgttcgtcgtttaaccg

SEQ ID NO: 172709 - DNA, 855 bp, Homo sapiens
  misc_feature: GYAE6OF02G6III.27.78.H01.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcgagggtgaattgtgctgactcagtctccagtactttcagtctgtnactacaaagganaagtcacatccaccgtcggaccggccagtccagacgtacggttaggtagtacggacttacgacgttacggtaccgagacacgaaacggccaggtaccaacgtacctaacccgaaacgtccttacccgtacaacttaacgaacgttacgtcgtacccctttaccccgtaaccggtttccctttccgtaccgggtaccggggttcccccgtggtacgggtttacctagggtcggtacgtacggtggtaacgttacgtcgggaactaacttaacgtttacccaaccctaccgaaccctaacgtaacctaacgttaaccggaccgtaacgggaaacgtccgtaaagggtaaacgtagttcggtactacgtaaaaccttaacgttttacctttaaaccgtgttaaccctaagttaaccgaacggtttaaacctttaaccgtttaaaccctttaacccgttaaaggttacgttacgttaaccgttaaccccttaaccggggtttaccccggaacggtaaaacccggggaccgttaaccgtaacgggttaccgggttaaagtaaaaccccggtttaaaacggtacggtttacgggttacccggtaccgttaaccggtacccgttaaaccgttaccgtttaacccgttcggtttaacccttaacccgg

SEQ ID NO: 172710 - DNA, 781 bp, Homo sapiens
  misc_feature: GYAE6OF02F0G3Y.27.78.H01.1.454.CMB.1.raw
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattggttctgctgctctgggttccagcctccgtaggggtgaaattgtgctgactcacgtctccagtactttcgacggtctgtcggactaccaaaggtagaaacgtccaccactccgaccgtcggccgggccacgtaccagacggtacggttggtacgttacgtcttaacgacgtcggtaacctacggaccaagaacgtcccgaggtccacggtcctaacccgaaacgtccttaccgtactacgttaaccgtaaagttacgtccggttacccttacccgtaacggttccctttacgtaccggtaccggggttcccctacgggtaccggtttacgacgggtacggtccgttaggttcggtaccgtcgtaacgggtacctaccgttactttacccgaccctacaccctagtacctaagtaccgtaccgtaggaacgtcgtaggaaccgttagttacgtccgttagtaaccgtaaacgttttaccgttacgttagtaccgttaacttacggtacgttaacctttaaccgtttaccgtttaccgttaacgtaacggttcgttaacccttaccggtacccggttaaccggaaccgggtaacgtccggtaaccggttacgtaacgggtaactaaaccggttaaccggg

SEQ ID NO: 172711 - DNA, 778 bp, Homo sapiens
  misc_feature: GYAE6OF02JFVIT.27.78.H01.1.454.CMB.1.raw
  modified_base (101)..(101): a, c, t, g, unknown or other
  misc_feature (101)..(101): n is a, c, g, or t
  modified_base (141)..(141): a, c, t, g, unknown or other
  misc_feature (141)..(141): n is a, c, g, or t
  modified_base (286)..(286): a, c, t, g, unknown or other
  misc_feature (286)..(286): n is a, c, g, or t
tcagagcgtcgtctcacgaccggtgctcgatttagtgtgagtagtttgggtttggggtagtgagcaaaactgacaagtcaaggcaggaagatgttgccatnacaactcattgggttctgctgctctggtcagcctcagggngaaattgtgctgactacagtctccagactttcaggtctgtagtactccgaaaggaggtaaaaggccaccaatcctaaccgtgggcccggggcctagtaccagagttccggttggagacgtcttacaccgttgtacccagacgtanacgccgaggttacagtccgtctaaaggcctccctacgtacttaccgaaagttaagtcggccttccgaacggttccttccggttacgaccgggtttcccccgtcgtaacgggtttccgaaggttccgggaccgtaaggttacgggaactttccggttcgggactaacgtacgttttccgaccccgttagaacccgtaataaccgtaattccggtacggtacgtaagggtacctaggtaaaagtcgttaacggtcttcggtaaccttaaacgtttaactttaccgttacgttaccgttaacgttacgacgttaaactacccggtttactttaaacccggtcttaaaacgttcgggtacttaccttaacccgtccgggttaaacaacccgggttagaacgtaccgtagggaaacggttactaaaaccggtacgtttacggacggtacgtttacggacctttaacccgtccgttaacggttctacgtttaacccgg

SEQ ID NO: 172712 - DNA, 728 bp, Homo sapiens
  misc_feature: GYAE6OF02I8PWI.27.78.H01.1.454.CMB.1.raw
  modified_base (310)..(310): a, c, t, g, unknown or other
  misc_feature (310)..(310): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtcgactaccgaaaggagaaaagtccaccatccaccgtcggccgggccagtcagacggtcgttggtagtacgcttacgacgtcggtaccagccaagaacgccaggtcagtctaccaaagtctcctanacttacaagtatgccttcccgacgttccttctccgacgggtcccctcggtacggttcgacggtcggcaggtcggtactcgtacgggactactacgtttacccacccgtaccgacctaactactaaacgttacgaccgtagggaaacgtccgtaaggaacgtacgtcggtactacggtaaccttaaacgtttaaccgttacgttacgttacctacggttacaaacggttaaccgttaaccttaaccgttttaacctaacgttaaggttcgtaaaccttaccgtaacccgtttaaccgggacccgtaaacgggtaacgtacccggtacgtacggaacgttaaacgttaaaaccggtaccgttaagggtaccgttacgtacgtaccgtaacccgtacgttaccgttacgttacccttaccg

SEQ ID NO: 172713 - DNA, 985 bp, Homo sapiens
  misc_feature: GYAE6OF02JFCNV.27.78.H01.1.454.CMB.1.raw
  modified_base (150)..(150): a, c, t, g, unknown or other
  misc_feature (150)..(150): n is a, c, g, or t
  modified_base (160)..(160): a, c, t, g, unknown or other
  misc_feature (160)..(160): n is a, c, g, or t
  modified_base (220)..(220): a, c, t, g, unknown or other
  misc_feature (220)..(220): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtntaaacttggngctgactcagtcctccatcgtttcagtctgtgactacgaaaggagaatcaccatcaccgnggaccggcagcagagtcgttaggtatacgtcttacgacgtacggtaccagacgacgtacgaccgagggtactacgtacccgtaccgaaaacgtccgttaccctcctaaccttaaccggaaacgttacgttaccggttacccctttacccccgttaacggtttccccgttttacccgtaacccgggttaccccggggggtttaccccccttacggggttacggggtttaccgttaacgggttcgggacgtaacggggttacgggtttaccggttaccggggtacgggtacccggttaaaaccttacctttttaaccccggtaaccccgttaaccctaaaccgttaacgtaaccgttaaacgttaccggtacccggttaacggaacggttacccgtaagggtaaggaccgtttccggtaacgttacgggtaaaccgtttaaaaccctttttacgtttaaccggttaacccggtttacttaaaccgtttaccggtaaaccgtttaacgggttaaaaccccctttttaaccggttttaaccccttaaacgggttttaacgttaacctttaaacggtttacccccgttaacccgggttttacccgggaaaccggttaaccggggtaaacccgtttacccgggttaaccggtaaaccggggttaacgtttaaaaacccggtaaaacggttaacccttttaacgggggtaacgttaccgtttacccggtaacccgtttacgtacctttacccgggttttaactttaccccgg

SEQ ID NO: 172714 - DNA, 647 bp, Homo sapiens
  misc_feature: GYAE6OF02F4Q81.27.78.H01.1.454.CMB.1.raw
  modified_base (344)..(344): a, c, t, g, unknown or other
  misc_feature (344)..(344): n is a, c, g, or t
  modified_base (502)..(502): a, c, t, g, unknown or other
  misc_feature (502)..(502): n is a, c, g, or t
  modified_base (528)..(528): a, c, t, g, unknown or other
  misc_feature (528)..(528): n is a, c, g, or t
  modified_base (559)..(559): a, c, t, g, unknown or other
  misc_feature (559)..(559): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
  modified_base (618)..(618): a, c, t, g, unknown or other
  misc_feature (618)..(618): n is a, c, g, or t
  modified_base (626)..(626): a, c, t, g, unknown or other
  misc_feature (626)..(626): n is a, c, g, or t
  modified_base (633)..(633): a, c, t, g, unknown or other
  misc_feature (633)..(633): n is a, c, g, or t
tcagagcgtcgtctcacgaccggtgctcgatttagtgtgagtagtttgggtttggggatgagcaaaactgacaagtcaaggcaggtaagatgttgccatcacaactcattgggtttctgctgctctggttccagcctccgaggggtgaattgtgcctgactcgagtctcagtactttcagtctgtgactacgaaaggagaacgtcaccgatccacgtcgcccgggtctacggtcaggagtccggttagtacgtagcttaaccgcgtacggacctagacgtaagtaacgcccgagggttaccacgttaccaccgaaagtccctccttacacgtacgtaaacggtnttccggacccttacccgtacggttcccttaccggtcggacccggggttcccctagggttacggttaccgaggttcgggtcgaggttgactttcggacgggtacaacttcttcccacctacacctacgtacaccgttagccgtaggacgtgaagaagtntcgactacgtaacttagtcttagtgntaactatacgtacgttaacttccgtaacgtnacgtctacctcgttaccttggacgtaacgacncgtagngtaacgtaagaccgttacggngtaccgtntacgctnacgtcttgtcctac

SEQ ID NO: 172715 - DNA, 829 bp, Homo sapiens
  misc_feature: GYAE6OF02JQ8BU.27.78.H01.1.454.CMB.1.raw
  modified_base (192)..(192): a, c, t, g, unknown or other
  misc_feature (192)..(192): n is a, c, g, or t
  modified_base (671)..(671): a, c, t, g, unknown or other
  misc_feature (671)..(671): n is a, c, g, or t
  modified_base (678)..(678): a, c, t, g, unknown or other
  misc_feature (678)..(678): n is a, c, g, or t
tcagagcgtcgtctcacgaccggtgctcgatttagtgtgagtagtttgggtttgggggtagtcttaaagaggttctttcttctggatgtggcatgagacaaaactaacaagtcaaggcaggaagatgttgccatcacaactcattgggtttctgctgctactgggttccagcctccgaggggtgtaaattgngctgactcagtcctaccagtactttcaggtccttggtcgacctacgaaacgggagtaacgtccaaccacgttaccacccgtgggaccccgggtctaacggtacagggcgtacggtttacgggaaggttactaacgtttaccgaacggttacggaaccccgtaggacgaaccggaaacggtaccccgtaacgggtacctaagggttaccccaaccgtaaaaggtcccccttaccttaactaaccggttaacccgtaagtttaccgtccgttaacccttccccgtaaccgtttcctaccgttacccgggggtaccggtcccccgtacggggttacgttaacggtccggtagggttacccgtaaggggttacggacccgtttacgggtacccggggtaacaaccggttacctttacccggtacccctacggtaaccctagttaccgaaacgtccgtacggtacggaacgcgttaggactaancgttacnccgtaacttacgtaacttacgtccgttaagactacgtacggttaactaacctttaccgtaccttactaacggtcgtaacttacccgtaccgtacccgaaggtaaccggaacgtacgtaaggtaccggtaaagttaccgaaacggttaccgg

SEQ ID NO: 172716 - DNA, 894 bp, Homo sapiens
  misc_feature: GYAE6OF02HSB4C.27.78.H01.1.454.CMB.1.raw
tcagagcgtcgtctcacgaccggtgctcgatttagtgtgagtagtttgggtttggggatcttaaaagaggttctttctctgggatgtggcatgagacaaaactgaacaagtcaaggcgaaggaagtattgttcgccatccaacaacttctagttttcgggttttcaggctggtccttcgttcggggttacccacggtcccgtaccggtaaggggggttagtaaaattttcgggtcgtcttacggaaccttccgtaggttcccttacccgtaggttaacctttacgacgtttcgttagggttacaaccgttaaaacggaaaaaggggtaacaaaccgtttcaaccctatacccgtaaccgggtcggaccccggggactaggttaccgaaaggcggtttacggttaggttaacggtacgtaccttacgtaacgtcggtacgaagtaccgaagaacgccgtagtacctacgtcctaacgaaactcctaccgtacaactagtaacgtctccgtaccttccgtacgttcctaccgtccggtacgggttcccctaggttcgacgtacgtgaccgtagggtcgtcgtacggtcggtaacgctttaccttaccgtaacccttacccgactaccttaacgtaaccttacggtacgtaaccggaacggttacgtaaggtaaacgtgtacgtaccgtaaccggtaactttaacttaccgtttaccgttaagttacctacgttaacgttaacgttaaccttaaccgtttaccctttaaccggtttaaccgtaacggttaccgtaaccctttaaccgtccccggtttaacccggaaaccggtaaccgggtaacccgttaacgggtaacccggaacgggtttaacccggaaaacggttttaacccggg

SEQ ID NO: 172717 - DNA, 717 bp, Homo sapiens
  misc_feature: GYAE6OF02ILFBT.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactacaaaggagaacgtcacatcactgccggcagtcagagtcgttaggtagtagcttacacgtcgtacagcgaagaacgccgacggtcagtcctaccaaacgtcctacctacatacaagttactcgtccttcccgtacgttcccttcgccgtaccgggttcccctggtacggttcgaggttcggacgtaggtcggtagttcggtacgggtaactaacttacgtttaacccacccgttaaccaacctaacgtaccgtaaagttccggtaccgttaagggtaacgtacgtaacggtaaacgtagtcggtacgtacgtaaccttaacgtttaattaccgttacgtacctaacgttacgtaacgttaacgttaacctttaacgtttaccctaacgtaacgtcgtaaccgttaccgtaccggttaaccggaccgtaaacgggtaccaccgtacgtaacggtacgtaaacgttaaaccggtacgttacgggtacgacgttcggacccgtacttacgttccgttcgttacctttaaccg

SEQ ID NO: 172718 - DNA, 713 bp, Homo sapiens
  misc_feature: GYAE6OF02IEOXZ.27.78.H01.1.454.CMB.1.raw
  modified_base (178)..(178): a, c, t, g, unknown or other
  misc_feature (178)..(178): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctcaggggtnaaattgtgctgactcagtctccagacttttcagttctgtgactccgaaaggnaaagtcaccatcacctgccggcagtcagngcgttggtagtacgcttacactggtaccagccagacgccgtaggtcagtacctaccgaaacgcctccgtacaactctaaagtatcgtccttacccgagttccccttacgtccggtaaccgggggttccccctttacggtacgggtttacgtaacgggtcgtaccgtagggttcggaacgtttcccggaggggtacctacttacgtttaccccaacccttaccgaaccgtaactaccgtaaacgtcgtacccggtaaggtaacgtaccgtaaggaaccgtatcgtacctacgacttaaacgtttactaacttcgttacaagttacgtagttaaccggttaaccttacgttttaccctacgtaacggttctaacgttaccctaacccggtttaccgaaccggtaacggaacccgtaaggtaccggtaacggtaacggtaaacctttaaaacccggg

SEQ ID NO: 172719 - DNA, 665 bp, Homo sapiens
  misc_feature: GYAE6OF02F011S.27.78.H01.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgagggtgaaattgtgctgactcagtctccagtactttcagtctgtgactacaaagganaaagtcacatcacctgccgggcagtcagcgtcgttggtagtagcttacacgtcggtaccagcaagaacgcctaggtactagtctaaccgaaagtcctcctanactacgaagtctcgccttacccgtagttccttcnccggtaccgggtccccttaggaggtttcagtggctaggtcggacttcgtacggaacctacgtactttaccgaaccccttcaacctaacgtactaaacgtacgtaccgtaggaacgtcgtaagaaacgtactcggactacgtaccttaaacgttacttacgtacgtactagttaccaaggtacctttaaccgttaactttaccgaagttaacgttagtactaccgttaccgttaccggaaacgaaccggacagtaccggtaagaacgttaacaaacggttacctggtaccgtacgtacgtacctaccggtagttccgttacgttcttaacccg

SEQ ID NO: 172720 - DNA, 567 bp, Homo sapiens
  misc_feature: GYAE6OF02FLGS3.27.78.H01.1.454.CMB.1.raw
  modified_base (445)..(445): a, c, t, g, unknown or other
  misc_feature (445)..(445): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcacatcacctgccggccagtcagagcgttggtagtagcttacactggtaccagcagaagccaggtcagtctaccaaagctcctcatcgaagtatcgtcttccattccttctcgacggggtcccctcggagttcaggtggcaggtggactcgtggacactattacaccctcaaccactacgtaactacgcctaggaacgctagaagatgctnacctaacttaactacgttgtctatcgaagtacgtaacttacctttaccacaagttagtacttactaacccgttaccggaccggtaacggaccaacggtactacgggtacgtaagttaaaccg

SEQ ID NO: 172721 - DNA, 646 bp, Homo sapiens
  misc_feature: GYAE6OF02G5K5K.27.78.H01.1.454.CMB.1.raw
  modified_base (146)..(146): a, c, t, g, unknown or other
  misc_feature (146)..(146): n is a, c, g, or t
  modified_base (462)..(462): a, c, t, g, unknown or other
  misc_feature (462)..(462): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagtctgtcgactccaaaggagaaagtccaaccatccaccgtggcccgggccagtcaggaggtcggttggtagtacgtcttacacgtcggtaaccagcaagaacgccaggtcacgtctccaaagcctcctcactacaagtatcgtccttcccacgttcccttctcggaccgggttcccctggtacgggttcaggtcgggacgtaggtggtactcgtacggggactacgtactttccaccctaccacctatacctaataccgtccgtaggaacgtcgtagaaacgtntacgctcgtactaactttacttacttagtactaactcgtaacgtacttaacttacctttacctagtacgtagtactaccgttaccggttaccgacgtaacgggacgtaccgtacgtacggaagttaacgtaaaccggtgtacggtgccgtacgtacccgtaacctgttcttacgttccttaccg

SEQ ID NO: 172722 - DNA, 665 bp, Homo sapiens
  misc_feature: GYAE6OF02I0WVG.27.78.H01.1.454.CMB.1.raw
tcagagcgtcgtctcacgaccggtgctcgatttagtgtgagtagtttgggtttgggggatcttaaaagaggttctttctctgggatgtggcatgagcaaaactgacaagtcaaggcaggaagatgttgccatcacaactcattgggtttctgctgctctgggttccagccctccgaggggtgaaagttgtgctgactcagtctccagtcctttcagttctgtcgactaccgaaaggagaaagtccaccatccaccgtcggcccggccagtcgagagtcgtggtagtagtcttacacgtcggtacacgacagaacgccgaggtacacgtacaccgtaaacgcctcctacacgtacaagttactcgtacctcccgtacgttcccttcgtacggtacccgggttcccgtaggtacggttacgaggtcgtacgtacggtcggtacggtcggtacggtaactaccgttacgtaccctaccccgtacaccctagtaccaaatcgaccgtagtaacgctaggaatcggctacgttacgaacccgttaatttaccgtaattactacggtacttaaccgtaagtaacgttaaccttaccgttacacgttagtcttaaccgtccgtaccgtacgaccggaaggccgtaacgccgtaaggtaacgtaccgtaacgg

SEQ ID NO: 172723 - DNA, 789 bp, Homo sapiens
  misc_feature: GYAE6OF02HH9KU.27.78.H01.1.454.CMB.1.raw
  modified_base (146)..(146): a, c, t, g, unknown or other
  misc_feature (146)..(146): n is a, c, g, or t
  modified_base (183)..(183): a, c, t, g, unknown or other
  misc_feature (183)..(183): n is a, c, g, or t
tcagagcgtcgtctcacgaccggtgctcgatttagtgtgagtagtttgggtttggggatgagcaaaactgacaagtcaaggcaggaagatgttgccatcacaactcattggtttctgctgctctggttccagcctccgaggggtanaaattggtgcctgactcagtctccagtactttcagtntgtgactccgaaaggataaagtccaacatccacctggcccggacagtcaggagtccggtttggtagtacgtccttacgacgttcggtaccagactaacgaaggccacggtccagtcctaccgaaagtcctaccgtccataccgtaagttactcgtacccttcccgtagttccccgttctacccggtacccggggttcccccttacggtaccgggtttaccgaacgggttcgggtaccggtaaggttacgggtacgttaccggtaccggggtaacctaacttaccggtttacccaaccccttaccaacgttactaccgaaacgttccgtacgtaggtaacctcgtaaggaacctagtcgtccgtaagtaccttaacgttaccgttaacgtgttaaccgtaacttccggaaacgttacgtttaccttaaccgttacgttaccgtaacggttactaccttaccgttacccgttaaccgggaacccgtaaacgggtacgtaacccggtaacgtacgggtaaacgttaacggtaaaccttacggtcggttacccgtaacggtacctaaccggtaccttaccggtttaccgttacgttaccgtttaacccgg

SEQ ID NO: 172724 - DNA, 790 bp, Homo sapiens
  misc_feature: GYAE6OF02FV8EP.27.78.H01.1.454.CMB.1.raw
  modified_base (271)..(271): a, c, t, g, unknown or other
  misc_feature (271)..(271): n is a, c, g, or t
  modified_base (780)..(780): a, c, t, g, unknown or other
  misc_feature (780)..(780): n is a, c, g, or t
tcagagcgtcgtctcacgaccggtgctcgatttagtgtgagtagtttgggtttggggggcatgagcaaaactgacaagtcaaggcaggaagatgttgccatcacaactcattggtttctgctgctctgggttccagcctccgaggggtgaaattgtgctgactcagtctccagtactttcagtctgtacgactccgaaaaggagaaacgtcaaccattccaccgtcggcccggcaagtcgagacggtcggtttaggtagtagtaccttaanaccgttcggtaaccaggacgaagaacgccgaggttaccgacgttacccaccgaaacgtccttacctctaactaccgaaagttcgtccgtccttacccgtaccgtttccttaccgtccgggtaaccggggtttccccgtacggttacgggtttaccgagggttcggaccggtagggtacgggtacgttccgggtacgggtaaacctacccgttactttaccccgaccccttaacccacgtacttaaccgtaacgtaccgtaaccggtaacggtaacggttacggtaacgtaacggtagtaccgtaccggtactaccgttaaactttacgttaccgtacgttacgtactacgtagtaacgtttaccgttacttaacgtacgttacgtacgtacttaacccgtccggttaaccggaccggtaacgggactacggtacggtaacgggtaacgttaaacgtaaccggtagttacgggttccgacgtacccggtacctacgtacgtttacccgtntttaacccgg

SEQ ID NO: 172725 - DNA, 820 bp, Homo sapiens
  misc_feature: GYAE6OF02H0I77.27.78.H01.1.454.CMB.1.raw
  modified_base (145)..(145): a, c, t, g, unknown or other
  misc_feature (145)..(145): n is a, c, g, or t
  modified_base (152)..(152): a, c, t, g, unknown or other
  misc_feature (152)..(152): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtnaaattgngctgactcagtctccagactttcagtctgtgactaccgaaagganaaagtcaccatccaccgtcggccgggaccagtcgagtagtcggtttaggtagtagtacttacgaccgtaggtaaccagtccaaggaacgccgagggtcagttcctaccaaacgccttcctactaatacaaaggttatccggtaccttacccgtagtttcccttccgtaccggtaccggggttccccctacggtacgggtttaccgaagggttcggaccgtaacggttacggtacgtttccgggtaagggtaccaaacttaaccggttttacccaaccccctacaaacccttaataacctaaaacgttaccgtcccgttagggtaacgtacggttaacgtaaacggtaagttcgacgttcggtaaaccttaaaccgttttagttaacccttaggttaaccgttaacgttaaccgtaaacggttaaccgttaaccgtttttaaccgttaacccttaacgttaaacggtaccgttaaccttaacccgttaaccgtttaccgggaaaccgtaacgggaaccgtaacgtacggttaacggtacgtaaaacggttaaccgtaaccggttacgggtaccggtacgttccgtaaccgtaccctaacgtttcgttacgttccgtttaaccgg

SEQ ID NO: 172726 - DNA, 565 bp, Homo sapiens
  misc_feature: GYAE6OF02F8HTK.27.78.H01.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
  modified_base (535)..(535): a, c, t, g, unknown or other
  misc_feature (535)..(535): n is a, c, g, or t
  modified_base (552)..(552): a, c, t, g, unknown or other
  misc_feature (552)..(552): n is a, c, g, or t
tcagagcgtcgtctcacgaccggtgctcgattagtgtgagtagtttgggtttgggatgagcaaactgacaagtcaaggcaggaagatgttgccatcacaactcattgggttctgctgcctctgggttccagcctccgagggtgaaattgtgctgactcagcctccagaccttcagtctgtgacctccaaaggnaaacgtcaccntcacctgccggcagtcagagcgtggtagtagcttaccactgaccancagagccnggtcagtctccaaagcctcctcagtcaagtangtctccagtcctcgtcgtacgggtcccctcgacgttcaagtcggcaggtcgtatcgngggaccactaacttccacccctcacccnctactaactcgacctagggacnccgtagaacattcgccgtagtacctaaccgttactaaccngtaccattcagtactacccttaacttaccgaactagtactaccgttacgacccgttcaaccggaagggacccacggtacctaggactaacgtaaccgntagcgctacgctaccgntcgtctgttaccc

SEQ ID NO: 172727 - DNA, 683 bp, Homo sapiens
  misc_feature: GYAE6OF02HSYI3.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctcgaggggtagaattgtgctgactcagtctccagtactttcagtctgtgactaccgaaggagaagtcacactcaccgtcgaccggcagtcgagagtcggttaggtagttacgaccttacgtacgtacggtaccgacgacgaaggaacgaccgaggttaccagttacctacaaacgtcctccgtactaactacaagttactcgttccctacccgttcgttacccttccgttaccggtacccggggttccccgttaccgggttacgggtttccggtaacgggtcggtacgacggttggtaacgttcggtacggggtacctacgttaccttacccgtaccctctaacctactactaagtcgtaccggtaacggtacgtacgtaggaacgtacgtgctacgtacttaatttctactatcctagtacaagtactaccttacgttacctacgtagtcaccgttacacgtaccgtaggacacgttacgaggtaacgtagtaactaacggtgtacgtacgaccgtcgacctcttacgtcttacgtacccttacg

SEQ ID NO: 172728 - DNA, 641 bp, Homo sapiens
  misc_feature: GYAE6OF02HPIAA.27.78.H01.1.454.CMB.1.raw
  modified_base (231)..(231): a, c, t, g, unknown or other
  misc_feature (231)..(231): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtagaaattgtgctgactcagtctccagtactttcagtctgtgactaccaaaggagaaagtcaccatcacctgccgggcagtcagngcggttggtagtagcttacacgtaggtaccagcagaagccaggtcacgtctaccaaagctacctcatacaagtatcgtacttaccctacgttcctttcgtccgtaccggggtcccctcggtacggttcgtacggtcggacgtaggtgggtaacttcggtacgggaacctacgttactttcccaaccccgtccaacccgtatacccaagtacccgtccgtaggaacgtcgtaagaagtacgtgcgttacgtacctaattttacttacgttacttacgattacgagtaccgtttaaccttaacgttacctacgtaagtcgtactacctaccgtacgaccgaacgtcgacgtagcgtaacgaacgttaacgaggtcgtacgaccgtagaccaccgtacttccttagtctaccg

SEQ ID NO: 172729 - DNA, 695 bp, Homo sapiens
  misc_feature: GYAE6OF02J2YXD.27.78.H01.1.454.CMB.1.raw
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
  modified_base (410)..(410): a, c, t, g, unknown or other
  misc_feature (410)..(410): n is a, c, g, or t
  modified_base (519)..(519): a, c, t, g, unknown or other
  misc_feature (519)..(519): n is a, c, g, or t
  modified_base (558)..(558): a, c, t, g, unknown or other
  misc_feature (558)..(558): n is a, c, g, or t
  modified_base (678)..(678): a, c, t, g, unknown or other
  misc_feature (678)..(678): n is a, c, g, or t
tcagagcgtcgtctcacgaccggtgctcgatttagtgtgagtagtttgggtttggggatgagcaaaactgacaagtcaaggcaggaagatggttgccatcacaactcattgggttctgctgctcgtgggttccagcctccgaggggtgaattgtgctagacctcagtctccagtactttcaggtctggtacacctacgaaaaggtagtaaacgtccacctatccaccgtgccccggggtcagtacgacggtagtccggttaggtacgtacgtaccttaccgtaacgtcggtaccaggtacaaggaacgccgaaggtcaacgttcacccaagtcctcctacgtanacgtaagtactcgttacctacccncgttccgttcgtaccggtaccgggtcccctaaggtcggttcncgggttacgcgtggtaccggagtttccgggaacgtaacctcgtaacctttaccccaccttaccaacgtactaccgaagtcgccgtacgggactacgtaaggaccgttancgtcgtactaccttaacttacgtactgactcgtacgtanaccgttacttaaccgtacgtacaggtactaacggtcccttacgggtaccacggttaacgccgtaacgagtaactacggtaacgtaaccgtcggtacgtacggtacgtacacgtacttacncgtttacgaccttcccg

SEQ ID NO: 172730 - DNA, 693 bp, Homo sapiens
  misc_feature: GYAE6OF02HTOIF.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtcctccagtactttcagtctgtgacctaccgaaaggagaacgtacaccatccaccgtgccggcagtcagagtcgttggtagtagcttacactcggtacagacagaacgaccgaggtcacgtcctaccaaacgtcctcctacactactaagtatccgtccttaccctacgttcccttccgtccggtaccgggttccccgtacggtacggttacacggttcggcgtaggtcggtacgtcggtacggactaccttactttaccctaccccgtactacctacgtaaccgaacgttacgtaccgtaacggactcgaggaaacgtacgtcgtacgtacgtaaccgttaactttaacgttacttacgtacttaagtaccgtacggttaaacgttccttaaccctttaccgtacgttaaccgtacgttacgttaaccctacccgttaccggaaccggtaaaccggcgtaaccggtaccgtagggtaaccgtaagttaaacccgg

SEQ ID NO: 172731 - DNA, 682 bp, Homo sapiens
  misc_feature: GYAE6OF02JFU6Q.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtcgaactacgaaaggagaaagtccaacctatccaccgtcgggccggtcagtcgacggagtcggttagggtagtcgtcttaacgaccgttcggtaccagacaaggacgccgaaggtcacgtcctacgaacgtcctcctacactacgtaactacgtcgtcccttccctacgttccgttccgtccggtacccgggttcccgtcggtacgttcgtaggtcggtacgtaggttcgagtcggtacggtacctactaccgttacctacccgtacctaacacttaacgtacgaccgtcggtagaaccgtgtaacgtagacgttgaccgttactaacgtttacttacgttctacgttactaacgtctaacgttacgttacttaaacctttcggtactacgtacttactaccgtccgttacgacgaacgacgtaccggagtaacggtaacgtaacgtaacgtacgttcgggactacgacgtacaccgtcgtttccgtactcgttaccc

SEQ ID NO: 172732 - DNA, 857 bp, Homo sapiens
  misc_feature: GYAE6OF02FQ5MA.27.78.H01.1.454.CMB.1.raw
  modified_base (495)..(495): a, c, t, g, unknown or other
  misc_feature (495)..(495): n is a, c, g, or t
tcagagcgtcgtctcacgaccggtgctcgatttagtgtgagtagtttgggtttgggggagtcttaaaagaggttctttctctgggactgtggacatgagccaaaactgacaagtctaaggcaggaacgtatgtttgccatcaccaacgtctacgttggggtttactaggtccttggtacctcgtcggggttacctacggtcccctacccgagggggttacgaaactttggtcgtccgtaggaaccttcgtacggtccctacccgtagttacctttcgacggttccttggtacgtacctaccggaaaagggtaagtaaacgttaccaccgttaactccgaaccgttccggggacccgaccctaggtaccaggtaccgtcggtttacggtaacgtacgtacccgtttaacgaccgttacgggtaacctaggtaccaacggtaacgaccccgtaaggtccgtaacgtacccgtaaccgtaaacggtcctaccccgtanaaccttacgaacgttagtcgttacccgttacccgtacgttccctttacgtacccgggtccggggttacccctacggtacggtttaccagggttccggtcgacgttacggactcggtacgggtactaccgtacttaccgtacccttaccgaacctaccgttacgtaaacgtccgtaaccgttagggtaacgttcgtacggtaagtacgtcggtacgtacggtaacctactttacgttacgttacgtacgtacgttctaaccggttaacgttaccttaccgtttacgaccgttagtccgtaacgtaccgttaccggtccggaacgtacggaccgtaccgtacggtaggtaacgttacgtaaacg

SEQ ID NO: 172733 - DNA, 630 bp, Homo sapiens
  misc_feature: GYAE6OF02FI26B.27.78.H01.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtnaaattgtgctgactcagtctccagtactttcagtctgtcgactccaaaggngaaacgtcaccatccacctggccgggccaggtcagngcgttaggtagtagcttacncgtacggtaccacgnacgaacgccaggtcacgtctaccaaacgtcctacctcactactaagtactcgtccttaccgtagttcccttctcggtaccggggtcccctggtacgttcgaggtcggcgtaggtacggactcgtacgggactacgtacttccacccgtaccaccactaccaagtacgtcgtagggaacgtctaacgtagtagttcgactagtacctaactttagtactcgtacactacacggtacttaaccgtttaccttactacgtaagtcgtaactcctacgttaccgacgtaaccggacacggtacgtcggtaacgtaacttaacggtacgtagtaccggctcgacctacacgttctacgttccg

SEQ ID NO: 172734 - DNA, 721 bp, Homo sapiens
  misc_feature: GYAE6OF02H1XIL.27.78.H01.1.454.CMB.1.raw
  modified_base (179)..(179): a, c, t, g, unknown or other
  misc_feature (179)..(179): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagactttcagtctgtgactccgaaagganaaagtcaccatcactgccggcagtcagngtcgttggtagtagcttacactggtaccagcagaagccaggtcagtacctaccaaaagtcctaccctcataccgaaagttctcggtcccttacccgtacgtttccctttccgtaccggtaccggggttccccctttacggtaacgggttttccgtaacggtcgggtacctaagggttcggtacgtttacccggttaggggaaccctaacgttaccttttacccaacccccttacctaaacctaattaaccgtaacgtaccggtaccgttaacggaacgtaccgtaaggtaacgtagtacgccgttagaaaccttaaaccttttacttaacgttacgttacctaacggtcttaaacggtacgttaaccctttaacctttaccgtaacgtacgttaacgtccttaccgtaacccgtcggaacccgtaagggacccaccgtagtaagtacgtaacttaaaaccggg

SEQ ID NO: 172735 - DNA, 607 bp, Homo sapiens
  misc_feature: GYAE6OF02IZ1DP.27.78.H01.1.454.CMB.1.raw
  modified_base (151)..(151): a, c, t, g, unknown or other
  misc_feature (151)..(151): n is a, c, g, or t
  modified_base (248)..(248): a, c, t, g, unknown or other
  misc_feature (248)..(248): n is a, c, g, or t
  modified_base (462)..(462): a, c, t, g, unknown or other
  misc_feature (462)..(462): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccagggggtnaaattgtgctgactcagtctccagactttcagtctgtgactccaaaggagaagtcaccatcacctgccggcagtcagagcgttggtagtagcttacnctggtaccagcagagccaggtcagtccacaaacgtcctcctcatcaagttatcgtccttccgtacgttccttctccggtaccgggttcccctggtacggttcgaggtggcgaggtggtacgtcgtagggactacgtacttccaccctctacctactacctaatcggcgtagggaaacgtctaggtaatagttcgctgacctaattacttacgtntacatcgtaatacgttaccgttacttacctagtagttacactcccgttacgtaccggaacgtaacgggaccgtacgtacggttagggaacttaacgtaaacggtagttcggtagtcgacgtaccgtactcgtttctcgttacccg

SEQ ID NO: 172736 - DNA, 765 bp, Homo sapiens
  misc_feature: GYAE6OF02J1RTF.27.78.H01.1.454.CMB.1.raw
  modified_base (244)..(244): a, c, t, g, unknown or other
  misc_feature (244)..(244): n is a, c, g, or t
  modified_base (508)..(508): a, c, t, g, unknown or other
  misc_feature (508)..(508): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccaggcctcgaggggtcaattgtgctgactcagtcctccagtcctttcagtctgtcggtactaccgaaaggacgaacggtccaccatcccgactcgggaccgggcagtcaagngtcggttggtacacggtcttacgacgttggtaaccagtcaaggtacgacgtaggtcgacgttcccgaacaacgtccttccgaatactacgaagtctcgcccttaccgtagttacctccggtacggtccgggtcccttaggtccggtttagacggtacgcggtaaggttcggacttccgggacggtacctacttacgtttccgaacccctacctaagttaaccgtccgtaaagtccggtacggtacggtatccggtagacgtacncgttccgataactacgtttactaacgttccggtataaccgttacgacgtttaccttaaaccgttttacccgttaaccggttagttaacgtaccgttaaacccttccgtttaaccgggtacccgggtaccggtaacggttacccgggacccgttagtaacggggtaactttaaacccggggttaaccgtaggttacccggggtactaccgggttacacccggttaacgcggttttaccccggtcgttacccgtttccg

SEQ ID NO: 172737 - DNA, 614 bp, Homo sapiens
  misc_feature: GYAE6OF02JMDYC.27.78.H01.1.454.CMB.1.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (477)..(477): a, c, t, g, unknown or other
  misc_feature (477)..(477): n is a, c, g, or t
tcagagcgtcgtctcacgaccggtgctcgatttagtgtgagtagtttgggtttggggtagtgagcaaaactagacaagtcaaggcaggaagatgttgccatcacaactcattgggtttctgctgctctgggttccagcctccagggtgaattgtgctgactcagtctccagactttcagtctgtgactaccgaaaggagaaagtcaccatcacctgccggcagtcagagcgttggtagngccttacncgtggtaccagcagaacgcaggtcagtctacaagctccnatcaagtatgccttccgagtccttcgtcgaccgggttcccctggtacggtttcaggttggccgtagttacgggattaccggtcgggaactaccgtacgttttccaacccccttacaaccaacgttacaaacgtttacgcccgtaggaactcgtacgaagattagtccagaccttaattacttactcgttanacttacgagtaacttaccgtttacttaccgtagtaacctgtacctccgttaacctcggtaaccaagggtaccaagtcgtagtaaccgtaattaaacgacgttgtacggactcgaaccgtccagtaccttgtcttacc

SEQ ID NO: 172738 - DNA, 601 bp, Homo sapiens
  misc_feature: GYAE6OF02GQHDT.27.78.H01.1.454.CMB.1.raw
  modified_base (151)..(151): a, c, t, g, unknown or other
  misc_feature (151)..(151): n is a, c, g, or t
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
tcagagcgtcgtctcacgaccggtgctcgatttagtgtgagtagtttgggtttggggggcgagtgagcaaaactgacaagtcaaggcaggaagatgttgccatcacaactcattgggtttctgctgctctgggttccagtcctcaggggtnaaattgtgctgactcagtctccagtactttcaggtctgtgactccaaaaggagaaagtcaccatcacctgccgggccaggtcagacgcgttggtagtagcttacacgtggtaccaggcagaagccaggtcagtctcaaagcctcctcatcgaagtntcgccttccgagtccttcgtcgacggggtcccctgaggttcaggtggcnggtaagctcgtgggacactcttccacctcaccatcaatcgtcagganctagaagtactgctgtacctattattactgtactatacgagtacgttacttacttacctacgtaagttacgtacttaccgtaaccgttaccggaccgtaacggggacctacgggaccgtagggaaaccgtaaacgttaaacgtaacgttacggacggtaccgttacgaccgtaaccgtacgttaccgtaccgttaccg

SEQ ID NO: 172739 - DNA, 901 bp, Homo sapiens
  misc_feature: GYAE6OF02HL65X.27.78.H01.1.454.CMB.1.raw
tcagagcgtcgtctcacgaccggtgctcgatttagtgtgagtagtttgggttggggatgagcaaaactgacaagtcaaggcaggaagatgttgccatcacaactcattggtttctgctgctctgggttccagcctccaggggtagaaattgcgctgactcagtctccagtactttcagtctgtgacctaccaaaaggacgaaagtcaccatccaccgtggccggcaggtcagaggtcggttaggtagtagcttacacgtggtaccagcagtaacgccaggtcacgtctaccaaacgctcctataacgtactaacggtatcggtaccttacccctacgtttcccttccgtaccggtacccgggggttccccctacgggttacgggttaccgaacgggttcggtaccgtaaggttcgggtaacgttccgggtacggggtaacctaaccgttaacgttttacccctaaccccgttacctaaccctaacgttaaccgtaaaacgtttaccgggtaacccggttaacgggaaacggttaccgttaacgggaaacgttacggttacggtaccgtaacgttaacccgttaaaaccgttttacgtttaaacccgttacgggtttaaccctaacggttaacccggtaaacggtttaaaccttaacccgtttttaaaccccgttttaaccgttaaaccggttaaacgtttaccgttaacccgtttaaccccggttaacccggttttaaccccggggaaaccggtaaaccggggtaaacccgtaaccgggttaaccggtaacggggtaaacggttaaaaccgtttaaaaccggtaacggttaacgggtaccggtaccgttacgacccgttaaaccgttacggtttacccgttacggttaaccctttacccgg

SEQ ID NO: 172740 - DNA, 791 bp, Homo sapiens
  misc_feature: GYAE6OF02F28D7.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtctccagtactttcagtctgtgactaccgaaaggagtaaacgtcaacactcaccgtgcccgggcaggtcaaggtagtcgtttagggtagtacgtcctttaacgacgttcgggtaacccaggcgaaagaacgtcccgaagggttcctaacggtacctacccgtaaaacggccttccctactaacttaccgaagttactcgtacccttacccgtacgttcccgtttcgtacccggaccggggttcccccttaggttacggttacgacggtcgggtcctaggtcggtagtccggtacgggaacctacttactttcccaacccgtttaccaaacctacttacgaaccgttaacgtccgaacggaaccggttaccgtaacgggtaacgtacgttacgtccgttaacgtactttaaaccggttaaccgtttacgttactacgttaaccgtaacgttaaacgttaaccgtttacctttaaccggtttacctaacgttacgttacgtaacttacccgtaccgtttaccggacgtaaacgggaccgtaacgtagacggtaacgtaaacggttaaaccttacggtcgtacgggttctaccggtacgtaacccctagtttcctaccgttaccttaccg

SEQ ID NO: 172741 - DNA, 537 bp, Homo sapiens
  misc_feature: GYAE6OF02JDVOY.27.78.H01.1.454.CMB.1.raw
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
  modified_base (471)..(471): a, c, t, g, unknown or other
  misc_feature (471)..(471): n is a, c, g, or t
tcagagcgtcgtctcacgaccggtgctcgatttagtgtgagtagtttgggtttggggatcgagcaaaacttgacaagtcaaggcaggaagatgttgccatcacaactcattgggtttctgctgctctgggttccagcctccagggtgaaattgtgctgactcagtctccagactttcagtctgngactccaaaggnaaagtcaaccatcacctgccggcagtcagagcgttggtatgcttacactggtaccagcagagccagtcagtctacaagctctcatcaatatcgacttcccgagtccttctcacgggtcccctgagttcagtgcgagtggntcgtgggacacgtagtttccaccctanaccagtacaactagcctgtaacgctagaacgntcgctcgataactacttcngtccatcagtacgtacttacttacctataagtgacttcaccgttcgaccaacgggtnaccgacgtggaacgtactaaacgtacgtgtacggacttacgaccaccgtacttcgtcgtcttaccg

SEQ ID NO: 172742 - DNA, 669 bp, Homo sapiens
  misc_feature: GYAE6OF02JXWDM.27.78.H01.1.454.CMB.1.raw
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctcgggttccagcctccaggggtgaattgtgctgactcagtctccagactttcagtctgtcgactcgaaaggctaaagtcaaccatcaccgtgcccgggaccagtcacggagcgttggagtacncttacgactcggtaccagcagaacgccgaggtcagtctaccgaancgtcctacataccagtactcgtacctcccgtaacgtccttcgtaccgacgggtcccctggtacgttcgaacgtcggactggttcgtacgtaccgtacgggtactaccttacttccgaccctgacctactanaacttccggcttacggaacnccgtagtaacgtacgtcgtctacggtaacttaacttactcgtacgtacacttaccgtagacgtttacctaacgtttcctacgtaacgttgtacttaccgtacccttaccggaaaccgtaacgggtacctaacggttacgtacggtaaacgttaaccggtaaaccgtacgttacggtacgttaccgtacgaccgttacccgaacgttccgttacgttaccggttacc

SEQ ID NO: 172743 - DNA, 724 bp, Homo sapiens
  misc_feature: GYAE6OF02JXVU7.27.78.H01.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (615)..(615): a, c, t, g, unknown or other
  misc_feature (615)..(615): n is a, c, g, or t
tcagagcgtcgtctcacgaccggtgctcgatttagtgtgagtagtttgggtttggggagtcttaaagaggttctttctctgggatgtggcatgagcaaactgacaagtcaaggcaggaagatgttgccatcacaactcattgggtttctgctgctcgtagggttccagcctccagggtgaattgngctgactanagtctcagactttcagtctgtgactccgaaagggacaagtaccaccagttccaccgtgccggaccaggtccaaggngcgttaggtagtacgtactttaccaacgtcggtacgacgacaacggtaacggtccaagggttccaagtaccgtacctaaagggcctaccggttacaacttcgttaaacgtactgttaccttacccgaggtttaccctttccgacggttaccgggtcccgtttagaacggtccagttcggtcctaggggtacttcggacgttaacggactaccgtagtttacccacccgttacgaacctacgtaacgttaacggaccgaccgttacggaaagttcccgtaaaagggttacctaacgttcggacgtttaaccgcgttaaaccgtttactttacgccgttacgttaancggaacgttaccgttattacgggtttaccctagaggttcaaccggtttaccaaccgttcggaacccgttcgaacggttacccgaaggttcgaaccgttaagttaaaccg

SEQ ID NO: 172744 - DNA, 770 bp, Homo sapiens
  misc_feature: GYAE6OF02FIZNO.27.78.H01.1.454.CMB.1.raw
  modified_base (179)..(179): a, c, t, g, unknown or other
  misc_feature (179)..(179): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccgaggggtnaaattgtgctgactcgagtcctccagtactttcgagttctgtcgactaccgaaaggagtaaactccaccactccaccgtcggcccgggcctagtacgaggtacggtcggtttagggttaacgtcgttaccttacgtacgttacggtaccgaggacaaggaacggtccgtaaggtctacgttacctaaccgaacgtccgtcctacacgtacagttactcgtaccgttcctacgtttccgttccgtaccggtaccgggttccccgtcgtacggtcgacggtcgcgtaggtcgtacgtcgtacggtactccgtactttcccgaccctacctacctactacctacgtaccgtacgtaacggaacgtaccgtagaacgtcgtcgtaccgttactaaccgtttaagtttaaccgtttacgttacgtaccgttaacgtaacgtttaccgtaacgtttaccctttaacgtttacctaccgttaacggttccgttaaccttacccggtttaaccccggtaaccggtaacccgggtaaacgggtaccccgttaacggtaaccggtttaacgggtaaccgtttaaaccgggttaaacccggg

SEQ ID NO: 172745 - DNA, 698 bp, Homo sapiens
  misc_feature: GYAE6OF02GHO85.27.78.H01.1.454.CMB.1.raw
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtcagagcgttggtagtagcttacactggtaccagcagagcaggtcagtctaccaaagctacctcatacaagtatacgtccttccctaaggttcccttcgtccgtacggggtcccctggacggttcaggtcggcaggtggtactcgtagggactactactttccaaccctacacctaataccaaactaacgcccgttagggaaacgcgttaaggaaacggtataggtactacggtaacctaaacgtttaactttaacgtagttacactacgtaacgtacgtttaaccttaaccttttaaccctacgtaagttacgtaacttacccgttaaccgtttacccggaaccggttaaaacggggaccgaaccggtacgttaacggggtaaacgttaaacggtttaaaaccgaacgttacggggttaacggtaccgtacgtaccgtaaccgttaacgtaccgtttccgtttaaccgttacccg

SEQ ID NO: 172746 - DNA, 712 bp, Homo sapiens
  misc_feature: GYAE6OF02GRZKM.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagtctttcagtctgtgactaccgaaagtagaagtccacactccactcggccggcagtcgagagtcgttcggtagtagtaccgttacacgtcggtaacgcgacgtaagacgcgtacgtacagtcctaaccaagcctaccgtctactacgtaagtactcgtaccttccgtaacgttccttccgtacggtaccgggtttccccgacggttacggttacgacgggttagtcgtaagtcggactcgtacggactcgtactttcccaccgttaccgaactagtaacctagtaccggtcgttaacggacgtgtaacgtagtgtacgcgttagaacccttaacgtttacgtaagttccgtcttaactacgtaacgtaccgttaacgttaccgtttacaaccgtaaggttacaccttaaccggtcccttaaccgggaaccgggaacgtaacccggtacggtacgtaagggttaaaaccgtaaccgttaacggtacgttaggtacggtacctaacccggtactaaccggttcttacgttcgtttaccgg

SEQ ID NO: 172747 - DNA, 656 bp, Homo sapiens
  misc_feature: GYAE6OF02JFZET.27.78.H01.1.454.CMB.1.raw
  modified_base (147)..(147): a, c, t, g, unknown or other
  misc_feature (147)..(147): n is a, c, g, or t
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
tcagagcgtcgtctcacgaccggtgctcgatttagtgtgagtagtttgggttggggatgagcaaaactgacaagtcaaggcaggaagactgttgccatcgacaactcattgggtttctgctgctctgggttccagcctccaggggtnaaattggtgctgactcagtctcagactttcagtctgtnactccaaaggnaaagtcaccagtccacctgcggccagtcagagtcgttgtagtagcttacacgttggtacccagcaaggaagtcccaggtccacggttcacctaaagtcctacctacactcgaaaagtctcgtaccttcccgagttccctttacgccggtaccgggttccccctaggtacggtttccgaggtcggacctaggtcggactcggtcgggaacctacggtaacctttccaacccttcgaaccacttaccaattacgcgtagaacgtctagaactagtcagttcgattaaccgttattactgtactatacgacgtaacgtaacctttccgttaaccacgaggtactactccgaccgttaacggccgaaacgggacctaacgcgttaacgggaattaaaccgttaaaccggagtttacggaacgtccgttagaccctaacctactttacgtacgtttccttaaccg

SEQ ID NO: 172748 - DNA, 658 bp, Homo sapiens
  misc_feature: GYAE6OF02FYZ7U.27.78.H01.1.454.CMB.1.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggcagtcagagcgttggtagtagcttacactggtaccagcagaagccaggcagtctaccaaacgctccctacatacaagtatgacttcccgataccttctcgtacgggtcccctccggacggttcagtggcaggtgganctggggacacactttcaccctcaacctatcaaatacgtccgtagggaatccgtacggaaagattacggactacgtactaaacttttaacgttaacttacggttactaacgtactaaacggttactttaaaccgtttacctttaacccctttaagaaacgttcgtaaattcccgtaacccgttcccggaaccgaaacgggttaacccgaacggtacgtagggtaaacggtaacgttaaaacgtaaccgtgggttacgggtctaccggtaccgaaccttactacgtacggttactttaacccgg

SEQ ID NO: 172749 - DNA, 731 bp, Homo sapiens
  misc_feature: GYAE6OF02GMEVK.27.78.H01.1.454.CMB.1.raw
  modified_base (146)..(146): a, c, t, g, unknown or other
  misc_feature (146)..(146): n is a, c, g, or t
  modified_base (237)..(237): a, c, t, g, unknown or other
  misc_feature (237)..(237): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagttctgtagactaccgaaaggagaaagtccaccatccaccgtggcccgggccagtcagngtcggtttaggtagtagcttacacgtcggtaccagcagtaagccgaggtcagtctaccaaagctcctcactactaagtatcgccttcccgtagttcccttcgtccggtaccgggttcccctaggtacggttcaggtcggcgaggtggtacttcggtggaactacgttactttaccgacccttacacctaacgtacctaaacgtaccgtccgtaacgggaacgtcggttaaagaacggtatcggtacgtaccgtaacttaaaccgtttacgttacgttacggtacttacgtacgtaaaggttaacctttacctttaaccgttttaacccgtacgtaaccgttagtaaccttacccgtaccgttaaccggtaacccgtaaacgggtaccctacggtacgttaacgggtaacgttaaacggttaaaaccgtacgggttacgttacggtacttaccggaccttaaaccgtctttaccggttcgttaccgtttaacccg

SEQ ID NO: 172750 - DNA, 799 bp, Homo sapiens
  misc_feature: GYAE6OF02IHXN3.27.78.H01.1.454.CMB.1.raw
  modified_base (146)..(146): a, c, t, g, unknown or other
  misc_feature (146)..(146): n is a, c, g, or t
  modified_base (153)..(153): a, c, t, g, unknown or other
  misc_feature (153)..(153): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgngctgactcagtctccagtactttcagtctgtgactaccgaaaggagaaagtccaacctagtccaccgtgcccgggacctagtccagtacggcggtttagggtacgtagtcctttaacncgtacggtaaccagaccaaggaacgccgtagggtcaggtcctaccgaaagcctcnctaatccgaaaggtactggtaccttcccgtacggttcccttctccggtaaccggggttcccccttacgggtaacgggttttcaacgggttcgggactacggtaccggtattaccggtaggggtaccaaccgtttacttacctaaccccttccaaacctacggttacaaacgttaccgtaccggttaggaacggactacggtaaaggtaccttagcgtagaccttaaacgtttactaaccggttgtactacggttactaacggtacttaacctttaaccctttaccgggttaaactagggtaacctaacggtttaccctaaccgtttaccgggaaacccggaaccgggtaacctaaccggtaacggtacgggtaaacgtaaacggtttaaaaccctaacgggtttaccggtacggttaccggtactacccgttaccggtaacgttttacccttaccggttccctttaaccccgg

SEQ ID NO: 172751 - DNA, 686 bp, Homo sapiens
  misc_feature: GYAE6OF02HM0GH.27.78.H01.1.454.CMB.1.raw
  modified_base (229)..(229): a, c, t, g, unknown or other
  misc_feature (229)..(229): n is a, c, g, or t
  modified_base (450)..(450): a, c, t, g, unknown or other
  misc_feature (450)..(450): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggttctgctgctctgggttccagcctccaggggtgaaattgtgctgactcagtctccagtactttcagtctgtgactccaaagganaaagtcacatcactgccggccagtcagagcgttggtagtagcttacactggtaccagcagaacgccaggtcgacgtctaccgaaacgcctcctcataccgaagtactcgccttaccctacgtcccttcgtccgaccggggttcccctcggtacggttacgacgtcgacgtaggtcggtactccggtagggtaaccctacgtacgtttaccacccccgttanaacccgtatacaaactacggcccttaagggaaccgtctaaggacgtagttcggacttccggaacttaaccgttaacttaccggtcgttaccgaacttccgtaaacggtacgtttaacccgttacctttaacccgttacgttaacggtcggttaacttacccgttacccgttccggggtaaacccgaacggggaccctaaccggtaccggtagggtaacgttaaccgttaaaaccgg

SEQ ID NO: 172752 - DNA, 639 bp, Homo sapiens
  misc_feature: GYAE6OF02FSF24.27.78.H01.1.454.CMB.1.raw
  modified_base (351)..(351): a, c, t, g, unknown or other
  misc_feature (351)..(351): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttaggtagtgacttacgactggtaccagcagaagccaggtctagtctaccaaagctcctcatacaagtatcgaccttccctagtccttctcacggggtcccctaagtcggttcaggtcggnaggtggtatcgtgggacatacttccgacccttacacccaatacgaactacgccgtacggaagaccgttagaacgagtacgtcgtacgtaacttaacttagttaacgttcgtatactacgtaagtacgttaacctttaacgtttaccctaacgtaacgttacgtaacgttaccctaccgtttaccggaccggtaaacgggacctaccggaccgttaggtaacggtaacgttaaacgtaacgtagtacggtacgtacggacctaaccgtacgtacgttactccgttaacc

SEQ ID NO: 172753 - DNA, 770 bp, Homo sapiens
  misc_feature: GYAE6OF02GAABV.27.78.H01.1.454.CMB.1.raw
  modified_base (178)..(178): a, c, t, g, unknown or other
  misc_feature (178)..(178): n is a, c, g, or t
  modified_base (541)..(541): a, c, t, g, unknown or other
  misc_feature (541)..(541): n is a, c, g, or t
  modified_base (570)..(570): a, c, t, g, unknown or other
  misc_feature (570)..(570): n is a, c, g, or t
tcagagcgtcgtctcacgaccggtgctcgatttagtgtgagtagtttgggtttggggggcatgagcaaaactgacaagtcaaggcaggaagatgttgccatcacaactcatttgggtttctgctgctctgggttccagcctcgaggggtgaattgtgctgactcagtctcatactttnagtctgtgactaccgaaaggagaaacgtccaactactaccacccgtcggcccgggacctaggtaccgaggacgtcggtttaggtagttacgacttaaccgacgtacgtaccagtcaagacgccgtagtacgactcctaccgaaacgtccttcctaacgattaccgaagtacgttccgtacccttacccgtacgtttcccttacgtcccgggtacccgggttccccgttacggtacgggttaccgtaggtcggtacgtaggtcgggtacttccgggtaggtaaccttaacgttacttacccgtaccctacgtaccgttaactacctaacgtcggtaccgtaggaacgtagtacgaagtacgtcncgttacgtaacttaacgtttacgttactnttaccgtacgtaacgtacgtttaactttaacccttaccgtttaacgaccgttaattccgtaacttacccgtttaaccggtaaccgtaaccgggtaacggggaccttaacggtacccggttaaggaaacttaaaccggttaacggtaacggtttcgacggtacctaccggtaacctacttacggttccggttactttaccg

SEQ ID NO: 172754 - DNA, 783 bp, Homo sapiens
  misc_feature: GYAE6OF02HIK1L.27.78.H01.1.454.CMB.1.raw
  modified_base (179)..(179): a, c, t, g, unknown or other
  misc_feature (179)..(179): n is a, c, g, or t
  modified_base (204)..(204): a, c, t, g, unknown or other
  misc_feature (204)..(204): n is a, c, g, or t
  modified_base (493)..(493): a, c, t, g, unknown or other
  misc_feature (493)..(493): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggttctgctgctctgggttccagcctccgagggtgtaaattgtgctgactcgagtctcagtactttnagttctgtcgacgtaccaaaagganaaagtcccaaccgtatccgaaccgtcggcccgggtaccagtccgtaaggagtccggttttaagggtaatcggtacctttaaccaacggttacggtaacccagacgaaggtaaccgccgtaacggttacacgttaccaacccgtaaagtcccttacctactactaacgaacggttatcgtaccgttaccctagttccctttactaaccggtaccggggttcccctaggtacggttccgaggtcgactagggtcgattcggtacggacctaacgttacttccaccccgtanaaccctagtacttaaagcgtacccggttagaacgtcgtaagaagtctggtaccttaatacctaacgttacgtttactacgtacctacgtactaacggttaccttaacgttacccgtttaaccgacgtttaaacggtacgttaccgttacccgttaaacggttacccggtaaacggaaccgttaccggaaccggttacggtaaacggttaaagaaacccgttttaaacggtaacgtgggttaaaccggtccctaaggtaccccgttacgtacctttagggtcccttaaccg

SEQ ID NO: 172755 - DNA, 828 bp, Homo sapiens
  misc_feature: GYAE6OF02JOO11.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctggtgactaccgaaaggganaaagtccacagtccacctcgccgggacctacgtcgaagacgtcggttaggtagtacgcttaacacgttacggtaccagacagaacgtccgaggttcagttacctacaaacgtcctcctactaagtacgaaacggttctaccggtacccttacctaaccggtttccctttaccgtccgggtaaccgggggttacccccttcgggttaacggtttccgtaacgggttacgccggtaaaggtttcgggtaaccgttacggttaccggggaacctaacttaacctttcccgtaaccccttacccaaccgttactacttaaacgtacggtaccggtttaagggaactaccggtaagtaaggtaatccgggtataccgtaaaccttacgtttaactttaccgtacggttacctaaggtacgtaaacggttctttaaaccttacccgtttaaccgaacttagtaccgtttaaacctccggtttacccggttaaccgacccggttaaaacgggtccgttaaccggaacgttacggaaaccggtttaaacctaaacggggttaacttccggggtactttaaacccggcggtaaccgtttacccgtagtttacccgtttagtccctttaaccccgg

SEQ ID NO: 172756 - DNA, 665 bp, Homo sapiens
  misc_feature: GYAE6OF02JJI9P.27.78.H01.1.454.CMB.1.raw
  modified_base (386)..(386): a, c, t, g, unknown or other
  misc_feature (386)..(386): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctgtgggttccagcctccgaggggtagaaattggtgctagactcagtcctccgaagtcttttacgagttcgtgtcgactaccgaaaggacgaaagtccaccatcccacctcggcccggacctagtacgaggagtcggttcggtagtacgtcttacacgtcggtaccacgcaacggaagccgaggtcaaggtcctacgtaacgctacctgaatcaaggttactcgtcttcccngtccttcgtacggacggtccctagcggttcacggtggcacggtgactcgagggtacaccgtacttccgtacctcctacctactacgtaacttacggaccgttaaggtaactaccgtagtaaacgatacggtcgtacgtaccttaagttacttacttacggacttacgtaacgtagtaaccgttacttaccgttaccgttaacgtagtacgtacctaccgttcggtacctaacggggtacaaccgggtaaccttagggaagttaccgttaaaggtaaccg

SEQ ID NO: 172757 - DNA, 776 bp, Homo sapiens
  misc_feature: GYAE6OF02JIYYP.27.78.H01.1.454.CMB.1.raw
  modified_base (194)..(194): a, c, t, g, unknown or other
  misc_feature (194)..(194): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactcaaaggngaaagtcaccatcacctgccgggccagtcagagcgttggtagtagcttaacacgtcggtaaccagcaaggaacgccgtaggtacacgtcctaccaaagcctacctacacgtactaagtatcgtccttcccacgttcccttcgtccgtaccggggttacccccttcggtacggtttccgaaggttcggtaccgtagggttacgggtaacgtttccggtaaggggtaacctaaccgttacgtttttacccgaacccctttaccgaaccctaactaaccgtaaacgtaacgtacccggttaacgggtaaaacgtccgtaagggtaaaacgtaacgttcggtaaccgtacgtaaccgttaaaccgtttttaactttaaccgttacggttacctaacttaccgtaaagttacgttaacccttttaactttaacccgttacgtaagttacgtaacttaccgtaaccgtttcggaccgtaaacggaccgtaacgtaccgttaggtaacgttaaaccgttaaacgtaacggttacggtacgggtccgttacgacccgtaaccgtacgtttaccttacggttcccttaccg

SEQ ID NO: 172758 - DNA, 811 bp, Homo sapiens
  misc_feature: GYAE6OF02JEIZN.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgcgtgactcagtctccagtactttcagtctggtgactccaaaggagaaacgtcaccatcaccgtggcccggccaggtcagaggtcgttgggttacgtacgactttacacgttcggtaccaaggcgaagaaccggaccgtagggtactaacgttccgtaccgaaaacggtcccttacccctacgtaactacgtaacggttaacgttcggtccccgtttccccgtaccgtttaccgtttccctaccgggtaacccggggggttaccccccgtttacgggtacggggtttacgtacgggttaccggggaccgttaggggtacgtaacgggttaccggttccggggtaaaccttacccgtaacgttttaccctaacccccttccgtaaaccctaacgtttaacgtaaacgttaccggtcctaacgggtaacgtacggtaacggagtatcggtactaagtaccgtaaactttacgttaacttcgtactaccgtacgtaggtacttaaccgttacctttaccgttaacgtaagttacacgttaccgttaacccgttaccggaaccgtaacgggtacgtaccggtacggacgggttaacgtaaacgttaaacgtcggttacggtacgtcgacgtacccgtaactaccgttgttacttaccgg

SEQ ID NO: 172759 - DNA, 799 bp, Homo sapiens
  misc_feature: GYAE6OF02IOV9X.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagtactttcagtctgtgactccaaaggagaaagtcaccatcacctgccgggccagtcagagcgttggtagtagcttaacactggtactagcagaagccaggtcacgtactccaaacgcctacctacacgtacaagtacgtcgaccttcccacgttcccttctaccggtaccggggttccccctacggtacggtttacgacggtcgggtaccgtaggtcggtaacttccggtacgggaacctaaccgttactttacccctaaccccgttccgtaacccacttaccgaaacgttacgtccccggttaaaggtaaccgtaccgtaacgaaacggtacttcggtaccgttaacgtaaccgttaaacctttaactttaacgttcgttaccgtaattaacccgtaggttaaacccgtttaaccgtttaaccttttaacccgtaacttaacgggtttaacgtaacccgtttacccgttaaacccggttcccgggaaacccgggtaaaaccgggtaccgtaacccggtaaccgttaaccgggtaacgttaaaaccggtttaaacggtaaccggttacggttacgggtaccgttaccggaaccgttacccgtaccgtttaccggttctttaacccgg

SEQ ID NO: 172760 - DNA, 748 bp, Homo sapiens
  misc_feature: GYAE6OF02GU9R4.27.78.H01.1.454.CMB.1.raw
  modified_base (520)..(520): a, c, t, g, unknown or other
  misc_feature (520)..(520): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtcgggttccagcctccgaggggtgaaattgtgctgactcagtcctccagtacctttcagtctgtcgactaccgaaaggagaaagtccaccataccacctcggccggccagtcaggacgtcggttaggtagtacgtcttaacacgtcgtaccagacagaacgccgaggtcacgtccaccaaagcctctcatacaagttatcgtaccttcctacgttcccttccgtaccggtaccgggttcccctcgggtacggttcgacggtcggaccgtaggtcggtactcggtagggtacctaccgtactttccccgaaccctacacctactaccaacttaccgtccgtacggtaagtaccgtagtaacgngttacgtacgtacgtaaccgttaaccgtttagtttacgttacgttacctacgttaaccggttaaacgttaaccggtttaacccctttaccgttttaacccgtaacgtttaaacgggttaccttaaccttaacccggttacccggttacccgggaaacccggtaaacgggtaacccgtaacggttaaccccggttaacgggtaaacggttaaccctttaaaacccgggg

SEQ ID NO: 172761 - DNA, 848 bp, Homo sapiens
  misc_feature: GYAE6OF02JCTM2.27.78.H01.1.454.CMB.1.raw
  modified_base (182)..(182): a, c, t, g, unknown or other
  misc_feature (182)..(182): n is a, c, g, or t
  modified_base (669)..(669): a, c, t, g, unknown or other
  misc_feature (669)..(669): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtanaattggtgcctacgactacgtacgtccaccgtacgttaccttcgtacgttcgttcggtacgtaaccgtaaccggaaagggtaaacgtaaaccggttacccaacctactacccgtaccggttccgggaccccggtaccgtacgtacgtacggtacggttacggttacgggttaacgtaccgttacgttaccgtacgtaccgtacgacgacgaagacgtacggtacgtacgtacgtaccaccgtaactccctacctactacacgttaacgtacgtccgttaccttaccgtaccgttccttaccgtaccgggttaccccgggttaccccgttagggttaccgtacggttaacgggtcggtacggttacgggtaccggttaccggtacgggttaaccggaaccttaacccgtttaccggtaaccccaccccttacgaaccttaacgtaaccgtagttacccgaaccggtagggaacctaagaccgggtaanccgttacggaccgttacaaacgtttaacgttattaccggttactacgttaactcggtaaacttccgtttaaacctttaccgtacctaggttaaccacgttacctaccccggttaacgaacccggaacgggtacgtaacccgcggttacccgtaaagggttaacccgttaataacccggg

SEQ ID NO: 172762 - DNA, 771 bp, Homo sapiens
  misc_feature: GYAE6OF02JO48D.27.78.H01.1.454.CMB.1.raw
  modified_base (145)..(145): a, c, t, g, unknown or other
  misc_feature (145)..(145): n is a, c, g, or t
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (434)..(434): a, c, t, g, unknown or other
  misc_feature (434)..(434): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtggttccagcctcgagggtnaaattgtgctgactcagtctaccagtactttcagtctgtgacctaccaaaggtanaaacgtcaaccatccaccgtcggacccgggcctaggtaccggacggtggttacggttacggtacgtcttacgtaccgtcggtacgacngacgaacgccgtacgtacgagtacctaccaaacgtcgtccctactaacgtacgtaagttacgtacgttcccgtacccttacgttccctttccgtaccgtcccggtaccccgtaggttaccggtcgtacgtcggacgtagttacggngtccggttaggacctaccgtttacgttaccctaccctcccgaacttcgtaactaacgtacgtaccgtacgggaactcgtaacgaaacgtacgtctacgtattacctaacgtttaaccttacgttacgttaccgtctaacgttacgttaactttaaccggtacctttaaccgtaccgttacgttacgtacgtttacctaccggttacccgtaaaccggtccggtaaaccgtaaccgtaccggtacggtaaccgtaagttaaacccggttacgtacggttacggttacgaccgtacctacccgtatttcccgggtttacttacccgtactttaacccgg

SEQ ID NO: 172763 - DNA, 792 bp, Homo sapiens
  misc_feature: GYAE6OF02HYEN5.27.78.H01.1.454.CMB.1.raw
  modified_base (150)..(150): a, c, t, g, unknown or other
  misc_feature (150)..(150): n is a, c, g, or t
  modified_base (181)..(181): a, c, t, g, unknown or other
  misc_feature (181)..(181): n is a, c, g, or t
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctcgtgggtccagcctccgaggggtanaagttgtgctgactcagtcctccgagtactttcagttcgtgtacgaactaccgaaaggtacaaacgtccaaccataccgaccgtcgggcccgggtacctagtaccgaaggtacgtacggttaggtaacggttacgccttaacgngttaccggaaccaggtaccgaacgacgtccgtacggttacgtacgtcctaaccgaactccctacccgtnaacgtacaacgtttccgtccgtaccttaccctacggtttcccctccggttaccgggtaccgggtttcccctagggttaacccggttgaacggttggaaccttagggtcgtacgttcggacggtaacctaccttacgttacccgtaccctaccgtaaccgtacttaaccgacgttcggtaacccgtaggtaaccggttacgttaggaaaccgttcgtaacgtccgttaactaaccctttaacgttttacgtaaccgttgtaaccgttacgtaccgttaaacgtaccgtttaaccttaaccttacgtacgttacgacgttaaccgttccgtaacccgtttaggaacccgttaacggacccgttacggttaaccggtaagtaccggttaaagtaacccggg

SEQ ID NO: 172764 - DNA, 743 bp, Homo sapiens
  misc_feature: GYAE6OF02FIWEW.27.78.H01.1.454.CMB.1.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (557)..(557): a, c, t, g, unknown or other
  misc_feature (557)..(557): n is a, c, g, or t
tcagagcgtcgtctcacgaccggtgctcgatttagtgtgagtagtttgggtttgggggatgagcaaaactgacaagtcaaggcaggaagatgttgccatcacaactcattgggttctgctgctcgtgggttccagcctccgaggggtagtaaattgtgctgactcagtcctccagtactttcagtctgtagactacgaaaggagaacgtcacctancaccgtggcccggctagtcaggcgtcggttaggtagtactcttacncgtcggtaaccagacgaaggacgccggtaggtactacgtcctaccgaaacgtcctaccgtactacgtactaacgttactcgtaccttaccctcgtccttcgtacggtacccggggttcccctaacggtcgggttaccgtagggtcggtacgtaggttacggtactcggtacggactacgttaccttacccgacccttaccaactacgactaacgacgccgtaaggtaacgtccggtaagaggtactcgggacctttacggaacctttaacgtacgtttaacttccggtacgttanaaccggtaacgttaaccgtttaccgtttaaaccttaccgtaacgttaagttccgtaacttcccgtaaaccggttaccgaacggtaacgtaccggtacgtacggtaaagacggttaaactaaccgggacgttacgtacggtactaccgttaccgaaccttcgttacccgttacgttacgttaccccg

SEQ ID NO: 172765 - DNA, 749 bp, Homo sapiens
  misc_feature: GYAE6OF02JJJSI.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctcgggttccagcctccaggggtgaaattgtgctgactcagtctccagtactttcagtctgtcgactccgaaaggagaaagtcaccatcaccgtgccggcagtcagacgcgttggagtagcttacgacgtcggtaccagcaagaacgccgaggtcagtcctaccgaagcctacctcacgtacaacgtagtacgtcctaccctacgttccttccgtccgtaccggggttcccctcggtacggttccgaggtcggacgtacggttggtacgtcgtacggggtaacctaccttacgtttacccacccgttacccaaccgtaacttaccgtaaacgtaccggttaccgtaacgggtaaacggtcgttaacgggtaacgtaacgtcggtaccgttacgtaaaccggttaaccttttaaagttaccttacggttaccttaacggttaccgaaacgtttaacgttaccgtttaacgtttaacccttaacggttaaccttacgtaaccgttaccttaaccggttaccgtaccggaaacgtaccgtaaccggacgtaacggtaacttaaccggtaaacgtacgtagggtacgtacttccggacctaccttaagttcccgtacgtaccgttacccg

SEQ ID NO: 172766 - DNA, 813 bp, Homo sapiens
  misc_feature: GYAE6OF02JVOZ4.27.78.H01.1.454.CMB.1.raw
  modified_base (224)..(224): a, c, t, g, unknown or other
  misc_feature (224)..(224): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcatttgggtttctgctgctcgtcgggttaccagccttacgagggggtataaattgtggctagactcagttcctccagtaccttttnacgtctgtacgactaccaaaagggacgaaagtccaacctattaccaccgtcggcccgggtacacggttacgacggaggtccggtttaggtaaggttacggtacctttaaccgtacgttcgggttaacgacggacgaacgggaaccgtaccgaacggttaccgtaaccggttacctaccgtaaacggtcccttacccttaccggtaactaacccgtaagttacttaccggtacccgtttacccttaaccggttccccttttaccgtacggggttacccgggttacccccgtagggttaaccgggtttaccgaaggtttcggacgttacggtacggtatacggttacgggactacgtacgtttaccgaccccttcgaaccctagtaccgtaacgtacggtaccctacgggagtacccgtaaggtactaccgttgtacgtacgtaacgttactttaaacttcgtagttaccagtacgtaccgttagtacccgtttaccttaccgtacgtaagtcgttactaccggttaacccgttacgtacccggaaacggtcccgtaaggaccggttaacggacgtttaaacttaaccggg

SEQ ID NO: 172767 - DNA, 804 bp, Homo sapiens
  misc_feature: GYAE6OF02H926C.27.78.H01.1.454.CMB.1.raw
  modified_base (144)..(144): a, c, t, g, unknown or other
  misc_feature (144)..(144): n is a, c, g, or t
  modified_base (164)..(164): a, c, t, g, unknown or other
  misc_feature (164)..(164): n is a, c, g, or t
  modified_base (316)..(316): a, c, t, g, unknown or other
  misc_feature (316)..(316): n is a, c, g, or t
tcagagcgtcgtctcacgaccggtgctcgatttagtgtgagtagtttgggtttgggggcatgagcaaaactgacaagtcaaggcaggaagatgttgccatcacaactcattggttctgctgctctgggtccagcctccagggtnaaattgtgctgactcagtcnccagtactttcagtctgtcgactaccgaaaggagaaacgtcaaccatcacctcggccggccagtcaggagcgttaggtagtacgtcttaccacgttacggtaccagtacgaaggaacgccgaaggtcacggtacctaccgaagtcctacctnactacaagttatcgtccttcccgtacgtccttcgtccggtaccggggtccccttacggacgttcaggtcggacgtaggtggtactcggtacggaactaccgtaacgtttcccaacccttacgaaccctactaaccgtaacgttaccggtaccgtaacgggtaacgtaccgtaaggtaaacgtacgttcgtaaccgttaacggtaactttaaaaccgttttacgttaaccgtttaacggtacttaaaccggttaaaccgtaaggttaaacccgttttaaccgttttaaacccttttaacccggtaacggttaaacgttcgtaaacccgtttaccccggttaaaccggtaaccggttaaaccggaaacccgggttacctaaccgggtaacggttacgggtaaactttaaaccggttaaaccggtaacgttcgggtaccgtacgttaccgtaaccgtaacccgtttacggtttcccgtacgttttaacccg

SEQ ID NO: 172768 - DNA, 814 bp, Homo sapiens
  misc_feature: GYAE6OF02I7UUE.27.78.H01.1.454.CMB.1.raw
  modified_base (147)..(147): a, c, t, g, unknown or other
  misc_feature (147)..(147): n is a, c, g, or t
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (315)..(315): a, c, t, g, unknown or other
  misc_feature (315)..(315): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccaggggtnaaattgtgctgactcagtctccagactttnagtctgtnactcaaagganaaagtcaccaatcacctgccgggccagtacaggacgtcgttggagtagcttaccacgtacggtaaccagcaggacgaccaggtcagtctaccgaagtctcctacactccaaaggttacngtaccttaccctacgttccctttacgtccggtaccggggtcccccttgggtaacgggttactaccggtaggtaccgtacggtacgggtaacttaccggtcggggtaacaacccgttaacgtttaccctaccctaacccgtaacctacgttaaccctaaaagtacccggtaccgggtaaggaaacccgtcgttaacgggtaaacgtcgtttccggaacctcgggtaaaccttttaaccgtttaaactttaccggttaccttacttacgttaccgtaacgttaaacggtttacctttaaacccgtttaacccttaacgtaaccggttacgttaacccggtactttaacccgggttaacccggtaccggaacggggttaaaccctcccggttacgttaacggtaacgtttaaaccggtttaaaaccgtacttacgggggtccgttaacccggttcgtacggtaaacccttacgtttccggtttacgtaacccgttttacccg

SEQ ID NO: 172769 - DNA, 809 bp, Homo sapiens
  misc_feature: GYAE6OF02GE082.27.78.H01.1.454.CMB.1.raw
tcagagcgtcgtctcacgaccggtgctcgatttagtgtgagtagtttgggtttggggatgagcaaaactgacaagtcaaggcaggagatgttgccatcacaactcattgggtttctgctgctctggttccagcctccgagggtagaattgtgctgactcagtctaccgagactttcagtctgtgacctaccaaaggagaaagtcaacccgataccgaccgtcggcccggaccgtagtccgaagtacggttacggttaggttaacgtaaggcctttaacgacgtacgggttacccgaggaccgtaaggaaacgcccgtaagggttaccaggttaccccttaacccgaaaacggtcccttacccgtacctaataaccgtaaaaggttatacggttcccttacccctacggttccctttacgtaccgtaccggggttccccctacgggtacgtttacgcggttacggaccgttaggtcgggaactccggtgggtaacctacgttaacgttaccccaacccttacgaaccctaacgtacgtaaaactaccgtacgttacggaacgtccgtaaggtaaacgtatacggcctacggtaacctaacgtttaacgtacttacggtactacgttacgaacgttcgttaaacctttaaccctttacacgttaacgtacgttaaccttaccgtaacccgttcggaaaccggaaccgggtaccaaccggttacgtaaggtaaacgttaaaccgttaaacgtaccggttaagccggttacgaacctacgtaaccgtagtttaccgttaccgtacttaaccgg

SEQ ID NO: 172770 - DNA, 679 bp, Homo sapiens
  misc_feature: GYAE6OF02JKGUJ.27.78.H01.1.454.CMB.1.raw
  modified_base (447)..(447): a, c, t, g, unknown or other
  misc_feature (447)..(447): n is a, c, g, or t
tcagagcgtcgtctcacgaccggtgctcgatttagtgtgagtagtttgggtttgggggcatgagcaaaaactgacaagtcaaggcaggaagatgttgccatcacaactcattgggtttctgctgctctgggttccagccctccgaggggtgaaacttgtgcttggactcgagttcctaccgagtactttccgagttctgtgacctaccgaaaggagaaagtccaccgataccacctgccggctacgtcagacgtcgttaggtacgtacgtactacgacgtcggtaccagcgaacgaacgaccagtcgacgtctaccgaaacgtccgtcctacgactacgtaagtactccgtcccttacccgtacttccgttccaccgggtaccgggttcccctacggtacggttcgaaggtcgcgtaggtcggtactcggtaggctactcttacccncccgtaccactactagtaactacgtaccgtagacgtagacgtaagtcgtagtacgtagtaaccctaacttacgttacttcgtactacgtacgttacgtacgtttaacgttacccttaacgtaaccttacggtaattaccgtccgttaccgtaccggaaccgtacgaaccgcgtacgaggtaacgtaacgtaaacgacgtacgtacgctacgaccgtactcgctttcgtaccc

SEQ ID NO: 172771 - DNA, 840 bp, Homo sapiens
  misc_feature: GYAE6OF02FOD6M.27.78.H01.1.454.CMB.1.raw
  modified_base (114)..(114): a, c, t, g, unknown or other
  misc_feature (114)..(114): n is a, c, g, or t
  modified_base (130)..(130): a, c, t, g, unknown or other
  misc_feature (130)..(130): n is a, c, g, or t
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
tcagagcgtcgtctcacgaccggtgctcgatttagtgtgagtagtttgggtttggggatgagcaaaactgacaagtcaagcagaagatgttgccatcacaactcattggttctnctgctctgggttccancctccagggtgaacttgtgctgactcagtctccagactttcagtctgtgactccaaacggngaaacgtcaccatcgacctgcccgggcagtcacgagccgtggtaggtacgtccttacncttaggtaccacggcaagaagccgaggtccaagtctacctaaaagctccctcactctaagtaatgtcttcccagtaccgtttcttcccaacgggggtccccctaccgggaggttaccgtaacgtacggggttacaacggttgggaactttcctacgggggtactaccaatttttacccgaaccccggtaaccctaaccccgtaacttaccgttaaaactacgtaccccgttaggggtaaaccacccggttgaaaacgggttacctacggtaccgtacgggtaccttaaaacctttaaacgtttttccggttacgttacccttaaactttacccaaaacgggttccggtttaaaaccttttaaacccgttttaacctaccccggtaaaagttttaaccggtaaaccggttacccttaaccccgggtttaaccgttacccggaaacgggttaaccccgggaagggtacccttaacggaacggtttaaaaccggtttaaaaacggaaaacccgttcggttaaccggggttacctacggggtaaccccgtttaaaccccagttaccccgttacggtttacccccttttaaaccgg

SEQ ID NO: 172772 - DNA, 614 bp, Homo sapiens
  misc_feature: GYAE6OF02F4V2W.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctcagtactttcagtctgtgactaccaaaggagaaagtcaccatcacctgccgggccagtcagaggtcgttggtagtagcttacactggtaccagcagaacgccaggtcagtctacaaagcctcctccatcaatatgccttcccagtaccttcgtccgacgggtcccctcgtaggttccagtggcaggtgtagtcgtgggcactcgttccaccctcacctactacaactacgactcggaagctaggaagtacgtgctcgtactaaacgtttattactcgttactattaacgacgttaacttaaccgttacccgttttaacctacgttaaggtactaacgttcctaccgtttcccgggaaacgtaacgggacctaacggtacgtaggtaacgtaaacgttaaaccgtacgtagtacggtcgttacgcgtacctagtccgttagtccttacg

SEQ ID NO: 172773 - DNA, 984 bp, Homo sapiens
  misc_feature: GYAE6OF02G1GFF.27.78.H01.1.454.CMB.1.raw
tcagagcgtcgtctcacgaccggtgctcgatttagtgtgagtagtttgggtttgggggggcatgagcaaaactgacaagtcaaggcaggaagatgttgccatctacaactcattgggtttctgctgctctgggttccagcctccgagggtgaaattgtgctgactcagtctccagtactttcagtctgtgactccaaaggagaaagtcaccatccacctgccggcagtcagagtacgttggtagtagcttacacgtcggtaccagcagaacgccgtaggtcgagtcctaccaaagcctacctacactacgaagttactcgtaccttccgacgttccgttcgtacggtaccggggtccctacggtacggttacgtacgggtcggacgtaggtacggtacgtccggtacgggtaacctacgtaccgtttacccaaccctaccgaaccctaacgtaccgtaaacgtaccggtaccgttaacgggtaacgtaccggtaaggtaaacgtacgttacggtaccgtacggttaaaccgttaaaccttttaacgttacgtttacggttacctaaccgttaacgtaaacggtttaacccggtttaaacccttttaacccgttttaaacccggttaacggttaaaaccgggtttaacccgggtttaaccgttttaaacccccgggttaacccccgggtttaaacccggggtaaaccccgggtaaaaccgggggtaaccccgtaaaccccggggtttaaacccgggggtttaaaacccgggggggtttaaaaacccccgggtttaaaaaaacccggggttttttaaaaaaccccggggtttaaaaccccggggttttaaccgggggttttaacccccggggttaacccccgggttttaaacccggggttaaaccccccccgttttaaaaccccgggttttaaaccccggtttttttcccccgggttttaacccccggttttttaaacccccccgg

SEQ ID NO: 172774 - DNA, 761 bp, Homo sapiens
  misc_feature: GYAE6OF02HKAD7.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccagcctccgaggggtanaaattgtgctgactcagtctccagtacctttcagttctgttcgacctaccaaaggagaaaacgtcaccatccaccgtcgccgggccagtcgagagtcgttaggtagtacgtacttacgcgtacggtaccagaccgaggaacgccgaggtcagtcctaccaaacgcctaccacacgtacaagtctcgtaccttccctacgttcccttcgccggtaccgggttccccgtaggtacggttactcggtcggtacgtaggtcgggacgttcggtacgggtacctacggttcctttacccgaccctaccacctagttaacctaacgttcgaccggtacggaacgtcgttaacgaagtacgtcgaccttacggaccttaacgtttcttacgttcgtacctacgtacgtaagttaccgtttaacccttaaccgtttaccgaacgttaacggtacgtaacccgttaccggttaaccgttacccggtaacggtaaaccgggtaccgtaaccgtacgggttaacggttaaccgttaaaggttaaacccggttaggttacgggacgtttaccggtacgacccgtaccggttaaccgtttaccgttccgttacccggtttaaccc

SEQ ID NO: 172775 - DNA, 612 bp, Homo sapiens
  misc_feature: GYAE6OF02G80KX.27.78.H01.1.454.CMB.1.raw
  modified_base (124)..(124): a, c, t, g, unknown or other
  misc_feature (124)..(124): n is a, c, g, or t
  modified_base (146)..(146): a, c, t, g, unknown or other
  misc_feature (146)..(146): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctntgggttccagcctccaggggtnaaattgtgactggactcagtctccagtactttcagtctggtnactccgaaaggngaaagtccaccatccacgtgcccgggcagtcagagtcgttgggtacgtagtcttaacgactggtaaccagtacgagaacgccaggtcacgtcctaccaaagcctacctcatcaagtatgcctccctagtccttctcgtacgggttcccctcggtacggttcaggtcggcgtagtggtactcggtaggactacgtagtttccaccctccaccactcaactacgtccgtaggaacgactacggaaacgtatcgtactcgtaacgtaaccttattactgtctancgtagtacgtacgttactttaccagtaagtnactacgtaccgtcggacccgtaggacctacgcgtaggacgtaagtaaacgacgttaggtacgtcgtagtccgtaacctagttccgttacgttcttacccg

SEQ ID NO: 172776 - DNA, 743 bp, Homo sapiens
  misc_feature: GYAE6OF02HZAKV.27.78.H01.1.454.CMB.1.raw
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (320)..(320): a, c, t, g, unknown or other
  misc_feature (320)..(320): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaaggaagatgttgccatcaacaactcatttgggtttctgctgctcgtgggttccagcctccgaggggtagaaattgtgctgactcagtcctaccagtactttnagttctgtcgactaccgaaaagggagaaacgtccaaccactacacccgtcggccgggacagcaggnggtcgttggtagtacgtcttacacgtacgggtaccngacgaagaacgccgacggtacgtagtacctaaccgaaactccttacctacaataccgtaaagtactcgtaccttcccgtacgttcccttacgtaccggtaccggggttcccctaggtacggttcgaggtcgacgtacggttggtacgtaccggtacgggaactacgttacctttaccccgtaccctacctaccgtaataaccgtaacgttaccggacccgtaggacgtacgtaaggaacgtagtcgaccgtacgtaccttaaacgttttacttacgttacgtactacgttaactaaggttaacccgtttaacttttaaccctttaccctagtttaacggtacttaccgtacccgttaccgttaaccggaccgaacgggtaacctaccggttaacggtacgttaacgtaaaccgtttaaaccgg

SEQ ID NO: 172777 - DNA, 538 bp, Homo sapiens
  misc_feature: GYAE6OF02I6ROI.27.78.H01.1.454.CMB.1.raw
  modified_base (391)..(391): a, c, t, g, unknown or other
  misc_feature (391)..(391): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaaagtcaccatcacctgccgggccagtcagagcgttggtagtagcttacactggtaccagcagaagccaggtcagtctccaaagctcctcatcaagtatgcttcccagtccttctcacgggtcccctgaggttcagtcggcaggtggatctgggacacactttcaccctcaccatacaatacgcctagggaagntagaagatgctcgactaacttattactgtcatcaagattacttactttactctaagtgataccgtaccgttccggacaagggtacacgactggataacgttaaacgaacgtgtacgacgtacgacctaccgtaatccgttgtcttac

SEQ ID NO: 172778 - DNA, 648 bp, Homo sapiens
  misc_feature: GYAE6OF02JBI8Y.27.78.H01.1.454.CMB.1.raw
  modified_base (298)..(298): a, c, t, g, unknown or other
  misc_feature (298)..(298): n is a, c, g, or t
  modified_base (426)..(426): a, c, t, g, unknown or other
  misc_feature (426)..(426): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcgaggggtgaattgtgctgactcagtctccagtactttcagtctgtgactccaaaggagaaagtcaccatccacctggcccgggcagtcgagagtcggtttggtagtagccttacacgttggtaccagcagaagccaggtcagtcctacaagctcctnatacagtatgtccttccacgtccttcgtcgtcggggtcccctggtacggttcaggtcggctaggtgtactcgtgggactacttattccaccctcaccatactaatacgcgtaggacgtcaagaacgtntggcctagacccttaactttacttactacgtctaactcgtaacgtaacgttaccttaaccttttaccgtagttaacgttctaaccgttcccgttaaacccgttaccgggtaacccgaaacggggtaccctaacgtaacggacgggttaaacgtaaacgttaacccgtaaacggtcggtttagacgttacgaccccgtaactacgtttaccttcgtttacccg

SEQ ID NO: 172779 - DNA, 865 bp, Homo sapiens
  misc_feature: GYAE6OF02H0C4O.27.78.H01.1.454.CMB.1.raw
  modified_base (148)..(148): a, c, t, g, unknown or other
  misc_feature (148)..(148): n is a, c, g, or t
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggttctgctgctctgggttccagcctccaggggtnaattgngctgactcagtctaccagtacctttnagttctagtgacctccgaaaggtagtaaacgtcaccatccgaccgtcggacccgggtccaggttccagtacggtccggttagggtacgttacgccttaacgaccgttacggtaccaaggtccggaacgtaacggcccgtagggtacctacggttccctaacccgaaacgtcccttaccctacgaataccgtaaagttcgtcggtacccttacccgtacgttccccttacgtccggttacccggttaccctcggtacggttccgtaacggtcgggtacgtagggttcggtacgttacggtacgggtaaccctacgtttaacgtttccccgaaccccgttaccgaacccttaacgttaacccgtaaacgttacccggtacccgggttaacggaaacggttcccggttaaaggtaaaccggttacgtaacggttacccgtacggttaaacccttaaaccgttttaaccggttaccgtttacggtaacccgttaaacgttacccggtaaacggttaaccgtttacccgtttaaacccgtttacgttaacgtaacggtttaccgtacgttacccggtttacggtaccgaaccggtaaacgggtacctaacgggttacgtaaggtaaccgttaaacggttaacgtacgttacggtacggtacgtcctaacaccgtttctcggtacttaccg

SEQ ID NO: 172780 - DNA, 797 bp, Homo sapiens
  misc_feature: GYAE6OF02IP38R.27.78.H01.1.454.CMB.1.raw
  modified_base (146)..(146): a, c, t, g, unknown or other
  misc_feature (146)..(146): n is a, c, g, or t
  modified_base (665)..(665): a, c, t, g, unknown or other
  misc_feature (665)..(665): n is a, c, g, or t
tcagagcgtcgtctcacgaccggtgctcgatttagtgtgagtagtttggggtttggggatgagcaaaactgacaagtcaaggcaggaagatgttgccatcacactcattgggtttctgctgctctgggttccagcctcgaggggtnaattgtgctgactcagtcctacctagtacctttcgattcgttgtacgaacctaccaaaaagggacgaaaacgtccaaccctaatcccgaaccgttcggacccggggaccctaggtaccgaaggtaccggtacgggtttacgggtaacggttaggtaccctttaacgaccgttacgggttaaccacggtaccgtaaaggaacggacccggtacggttacctaacggttaccctaaccgtaaacgtcctaccctactaactacgtaaggttactcggtacccttacccgtacgtccctttaccgtccggtaccccggggttaccccctaggtacggttactaggggtcggactaacggtacggtacttacggttcgggaactaccgttacttacccgtaccccttaaccaccgtaacgtacctaacgtaccgacggtaggaacgtaccgagaactgtcgtactcggaacttacttacttacgtcgtactacggtactaacgtacgttacttacccgtttanacgttaagtacgtacgttacctccggttacccggaacgtaaacgggtcgaaccgtacgttagggaactaaacggtttaaaccgtcggtcggtacggtacctcggaacctacgtactacgttcgttactcccg

SEQ ID NO: 172781 - DNA, 747 bp, Homo sapiens
  misc_feature: GYAE6OF02HC2DB.27.78.H01.1.454.CMB.1.raw
tcagagcgtcgtctcacgaccggtgctcgatttagtgtgagtagtttgggtttggggatgagcaaaactgacaagtcaaggcaggaagatgtgccatcacaactcattgggtttctgctgctctgggttccagcctccaggggtgaaattgtgctgactcagtctcagactttcagtctgtgactaccaaaggagaaaagtcaaccatcaacctcgccgggccagtcagagcgttggtagtagtactacacgtggtaccaggacagaagccaggtcacgtctacaaagctcctacatactaacgtaatagccttacccgattcctttcctacgtaccgggttcccctacggtacggttcgaacggttggacacggtaggtactcggtacgggacctacgtactttacctaccctaccaacccgtaataacccaaaagtacgtacccgtagggtaacggaccttaggaaagtaacggtagtcgttacggacttaaaacgttattaacttacggtactaactacgtaagtaacttaaccggttaaccttttaaccgtaccgttaaagtaccggaactttcccgtaaaccgttccggtaaacccggaaacggggtaacccgtaacggtaaacccgttaagggtaaaccggtaaaacttttaaaacccggaaaccgtttaagggttaccggtacccgttaaggtaaccccgtaaccgttaaactttccgttaccggtttacttaaccccgg

SEQ ID NO: 172782 - DNA, 640 bp, Homo sapiens
  misc_feature: GYAE6OF02H2TKJ.27.78.H01.1.454.CMB.1.raw
  modified_base (577)..(577): a, c, t, g, unknown or other
  misc_feature (577)..(577): n is a, c, g, or t
  modified_base (634)..(634): a, c, t, g, unknown or other
  misc_feature (634)..(634): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaggagtaaagtcaaccatcacctggccgggccagtcagagtcgttggtagtagcttacacgtggtaccagcagaagccaggttcagtctaccaaagcttcctcactcaagtactggtccttccccgaagttccctttctaccggtacggggttccccctaggtcggtttcgacggtggacgaggttgggactcgtaggggaacaccgttattttcccgacccttcgacctaacgtacctaacgtacgccgtagggaacgacttaggaaagactcggtctacggacttaaactttatttacgtacgttacacttacgagttaacgtacctttaacctttaaccgtaccaagtcttactacgtaccttccgggaaccgaaggaaccncgtacgtaggtgtaaactaacgagtacggtcgactacgtcaacctcgttcttccgtnttaccg

SEQ ID NO: 172783 - DNA, 673 bp, Homo sapiens
  misc_feature: GYAE6OF02IE79P.27.78.H01.1.454.CMB.1.raw
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (562)..(562): a, c, t, g, unknown or other
  misc_feature (562)..(562): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgagggtgaatgtgctgactcagtctccagtactttacagtctgtnactcaaggagaagtcacatcacctgccggacngtcagngtcgttggtagtacgcttacactggtaccagacagacgccaggtcacgtactaccaacgtctccctanatacctaaggtattcgtccttaccctacgttcctttccgtaccgtaccggggttcccccgtacgtaggttacgtacggtcggtacgaacgggttcggtagtccgtacgggtaacctaacgttacctttaccccgaaccccgtacgtaccctaacttaccgaactacgaccgttagggaaacgtccgtaagaagtacgtcgaactcgtaaccttaattacgttaccttagctatacgtactaagtttaccttaccgttaacacgtacgtntactacctacgtacccggtacgaacggacaccggtagtacggaaccgttaagtaaccggttacgtcggttaggtaccgtacgtaccgtacccgtattccgtagtttacccg

SEQ ID NO: 172784 - DNA, 692 bp, Homo sapiens
  misc_feature: GYAE6OF02GN744.27.78.H01.1.454.CMB.1.raw
  modified_base (147)..(147): a, c, t, g, unknown or other
  misc_feature (147)..(147): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctcagggtnaaattgtgctgactcagtctccagtactttcagtctgtgactccaaaggagaaagtcaccatcacctgccggcagtcagacgcgttggagtagcttacactggtaccagcagaacgccaggtcagtcctacgaaagcctcctactactactaagtactcgtccttacccagttccttcgtacgacggggttccccctggacggtttccaaggttcggaccgtaggtacggtagttaccgtacgggtaacctaactacgttttacccaacccttaccgaaccctaattaccaaacgttacgacccgtaagggtaactaccgtaggtaaacgtatcgtactagtaaccgttaaacttacgtttaacgtcgtaacgacgttcgaagtaacgttaaccttaacctttacccgtacgtaagttgtaaccttaccgttacccgttacggaaccgtaacgggactaccggtaacgtacggtaacgtaaacttaaacggtaccgttaggtacggtaccgttacgaaccgtacctacgtttaccgtacttaccg

SEQ ID NO: 172785 - DNA, 614 bp, Homo sapiens
  misc_feature: GYAE6OF02G1WH5.27.78.H01.1.454.CMB.1.raw
  modified_base (435)..(435): a, c, t, g, unknown or other
  misc_feature (435)..(435): n is a, c, g, or t
  modified_base (608)..(608): a, c, t, g, unknown or other
  misc_feature (608)..(608): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaaccatccaccgtcggccgggacctagtcagagtcggttggtagtacgtcttacacgtcggtaccagcagaacgccaggtcagtctaccaaacgctcctcatactaagtatcgtccttccgacgttccttcgtcgtaccgggttccccgtcggtacggttctacggtcggctaggtggacgtcgtacgggacactacttacctaccctcacctactactaagtacnccgtaggactcgtaggaagtcgtacgtacgtagacctaactttacgtttactgtactactagtacgtattaccttaaccttactacgtaagtcgtactcctacgtacgacgaacggtacacgacgtaggtaacgtaataacgtagtacgtcgtacgacactaccgtatccgtnttaccc

SEQ ID NO: 172786 - DNA, 824 bp, Homo sapiens
  misc_feature: GYAE6OF02HMCJU.27.78.H01.1.454.CMB.1.raw
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgttgggttccagcctccgagggtnaattgtgctgactcagtcctcagtaactttcagtcgtgtagacctaccgaaaaggacgtaaacgtccacctactacctacccgtcgggccgggacctaggtccaaggtacggtccgggttttagggtacggttacggtaccctttaacgaccgtttacggtaaccgtaaggaccgaagggaaccggacccgttaggtaccgtacgtaccctaacccgtaaacggtccctacccttactaacgttaaccgaacgtttacgtccgtacccgttacccgttacggtttaccccttccggttaccggttacccggggttaccccgtttacggttacggtttacgtacggggttcggtagtaccgggttagggtacctttacgggtacggtacctaaccgttactttaccccgtaccctacctaacccgtactaacctaacgtacggtacccgagggtaaacgttcgtaagaacgtcgtacgtacgttacgtaacgtttaactttaaccggttactcttaaccgagttaccgtttaacgtaaacccgtttaacttaacccgttttacgaacgttacggttcaaccgtttaccgtacccggttacgaacggtaaccggacgacgtacggaacgtacgttaaactaacgg

SEQ ID NO: 172787 - DNA, 713 bp, Homo sapiens
  misc_feature: GYAE6OF02I1TEI.27.78.H01.1.454.CMB.1.raw
  modified_base (115)..(115): a, c, t, g, unknown or other
  misc_feature (115)..(115): n is a, c, g, or t
tcagagcgtcgtctcacgaccggtgctcgatttagtgtgagtagtttgggttggggatgagcaaaactgacaagtcaaggcaggaagatgttgccatcacaactcattggtttcngctgctcgtggttccagcctccgagggtgaacttgtgctcgactcagtctccagtactttcagtctgtcactacgaaggacgaatccgactactcaccgtggccggtacagtcgagacgtcggttggaagtcgtacttacacgttaggaccagacgaaggaacgtcgacggtcacggtacctacgaactcgtactacagtacgtaaatcgtccgtacctcgtacttcttaccgtacgacccggttccaggttccgttacgaggtcgtgaacggttgtaacgttcgggaacgtaccgttaccttcgtttaaccccaccgttacctaaccgtaagttaccctagggtaacccggttccggtaacggtaacggtacgtacgggtaagtaccggttacggtaactaccggtttaaactaaccgtttacgttaacttcggtacttacgtaagttaccgtacttaacttaccgtatacgtacgtactacgtaccgttaccacggtaaccgaacgtaccgtaacgtgacgtaaacgtaacggtaacgacggttacgtaccggtactacggtaccctaagttccgtacgtttcgtacgttaacccg

SEQ ID NO: 172788 - DNA, 703 bp, Homo sapiens
  misc_feature: GYAE6OF02FJBE7.27.78.H01.1.454.CMB.1.raw
  modified_base (308)..(308): a, c, t, g, unknown or other
  misc_feature (308)..(308): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaattgtgctgactcagtctcctagactttcagtctgtgactccaaaggagaaagtcaccatcacctgcccgggccagtcagagtcgttggagtagctttacacttcggtaccagcagaagccgaaggtcagtactaccaaagcctcctcatcaagtacncgtccttcccacgtcccttctccgtaccggggtccccttacggacggttcgaggtcggacaggtggacttcgtacgggactactactttcccgaacccttccaaccctataacctaaacgtaccgtaccttagggaaactaccgttagaaggtacgtcgtcctacggaaccttaaactttacttaaccgttacggtactaacgtccgtaagtaacgttacctttaaacctttaccaaccgttaaagttcgtaacttaccgttaacccgttaccgggaacccgtaaacgggaaccgtacgtaccggttaggtaacgtaaaacgtttaaaccggaacttccggtaaggtaccgtagggacctaaccgttaacgttccgttacgttaccgtttacccg

SEQ ID NO: 172789 - DNA, 668 bp, Homo sapiens
  misc_feature: GYAE6OF02GK4QR.27.78.H01.1.454.CMB.1.raw
  modified_base (180)..(180): a, c, t, g, unknown or other
  misc_feature (180)..(180): n is a, c, g, or t
  modified_base (342)..(342): a, c, t, g, unknown or other
  misc_feature (342)..(342): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccaggggtnaaattgtgctgactcagtcctcagtactttcagtctgtgactacgaaaggagaagtcaccatccacctcggccgggccagtcaggtacgtcggttaggtagtacgtcttaactacgtcggtaccagacaagagaccgaggtacagtcaccaacgtctcctanactacaagtactcgtccttccgactttcccttctccggtaccgggtccccgtacggtacggttcgtacggtcgcgtaggtcggtatcgtacggtactactacttacctaccctaccgtacctactactaactacgtccgacggtaacgtacgtacgaagtacgtacgtacgtacgtactaacttaacgttactacgtacttaactacgtaacggtaacgttacttaacctttaccgttactaacgtacgtacctaccgtaccgttaccggaaggaacccccccccggaagtaccgtaacggtaacggtacggtaacgttaaaccgg

SEQ ID NO: 172790 - DNA, 795 bp, Homo sapiens
  misc_feature: GYAE6OF02IFWTU.27.78.H01.1.454.CMB.1.raw
  modified_base (145)..(145): a, c, t, g, unknown or other
  misc_feature (145)..(145): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccgagggtnaaattgtgctgactcagtctccagtactttcagtctgtgactacaaaggagaaacgtcaccatcaccgtgccggcagtcagtacgngttggtagtagcttacnctggtaccagcagaacgccgaggtcacgtacctacaaacgcctcctacataccgaagtacgtcgtaccttcccgtacgttcccttcctaccggtaccggggttaccccgtacggttacggttcgtaacggttcggtacgtacggtcgggtagttcggtacggggtacctaccgttaacgtttacccgtaacccgtacctaaccctaaacgttaccgtaaagtaaccggttaccgtaacgggtaaacgttccgtaagggtaaacgtacgttacgtacgtaacggtacccttaaacgtttttaacttaccgtttaacgttaccgtaacgttaaccgttaagttaccgttaaaccgttttacccgttttaaaccgtaaccgttaacggttacgttaaccgttacccgttaaccggtttacccgggaccggtaaaccgggtaaccgaccggttaccggttaacgggtaacgttaaacgttaaaccggttaacgttcgggtaccggtcgttacggacctaaccgtaccttcggtttctacccgtttaacccg

SEQ ID NO: 172791 - DNA, 727 bp, Homo sapiens
  misc_feature: GYAE6OF02GGUJL.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtggttccagcctccgaggggtagaattggtgctgactcgagtctaccagtactttcgagtctggtcgaacctccaaaggataaacgtccaaccatccaccgtcggcccgggccagtccgagtacggtcggtttggtaagtacgtaccttaacgacgttacggaccaggacaacgaacgccgaggtacctacgtacctaccgaaacgtccttacctcaacttaccgtaaagtacgttccgtccctttaccccgacgttccctttacgtccggtacccgggttcccctaggtacggtttccgaggttcgcgtagtacggagttcggacggactacgtactttcccgaaccctacgtaaccaagtactaactcgaccgttaggaacgtcgtaagaacgtcgtgaccttacgactttaaactttacgtcgttacacttacgacgttaacgtactttacctttaacgttacgaagtttacgtacgtaaacgttcccgtaaaccggttcccgaaaccggtaacggaaccgtaacgtacgtaggtaactaaacggtaacttaacggtgtaacgtcgtactaccgtaactcgtacgtccgttaccgttac

SEQ ID NO: 172792 - DNA, 709 bp, Homo sapiens
  misc_feature: GYAE6OF02IRL5Y.27.78.H01.1.454.CMB.1.raw
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggttcagcctcgagggtgtaattgtgctgactcagtctcngactttnagtctgtcgactcgaaaggagaagtcactancgacctggccggccagtcgagtagcgttggtagtcgctacactggtaccagcagagccaggtcagtcncgaaanccgtcctcgatacagactcgcttccgagttccgttcgtcgtaacggggtccctagacgtttcgacggtgggtacaggttaggaacgttcgtcgggtaactacgttacgttttacccacccggtacctaaccgtacgtacgtaacgtaacggcccttagggaaacgtccgtaaacgaaggtacgttacggacttcgaacggttaaccttttaaacgttccgtttaacgtaccgttaattaccgtaaggttaccgttaaacctttaaccgttttaccgtaacctagggttaacgtaccgttaccgacccggtttaacgggacccttaaaaggggtcccgaaacgggtccgttaagggactaaacggtttaaaccgtaacgttggtaccgtacgggtcaacccgtacgtaacgtacgttccggtattaccccg

SEQ ID NO: 172793 - DNA, 833 bp, Homo sapiens
  misc_feature: GYAE6OF02HU66V.27.78.H01.1.454.CMB.1.raw
  modified_base (161)..(161): a, c, t, g, unknown or other
  misc_feature (161)..(161): n is a, c, g, or t
tcagagcgtcgtctcacgaccggtgctcgatttagtgtgagtagtttgggtttggggatgagcaaaactgacaagtcaaggcaggaagatgttgccatcacaactcagttgggtttctgctgctctggttcagcctccgaggggtgaaattgtgctgactnagtctccagtactttcagtctgtcgactaccgaaaggaagaacgtaccaaccagtaccacccgttcggcccgggacctaaggtacgaacggtaggtcggtttagggttacggttaacgtcctttaacgaccgttacgggtaacccgaagacgaacggaacgtaccgacggtacgtacgttacccgtactaaaaccgtccttaccctacgtaacgtaactaaacggtacgttacgtaccctttacccggtaccgtttacccgtttaccgtaccgggtaccgggttacccccgttaggttacgggttacgtacggtcggtaccggtaggtacggtacgttcggttacgggaactaacgttacctttaacccacccgttaccgtaccgtaacttacctaaacgtcccgacggttaacggaacgtacgtacggaaactcggtacgtacgtacggtaacttaactttaacgttaacgttacttactacgtaccgtaagttactttaaccttaaccgttttacaaccggttacgtacgttacgtacccgttaccgttacccggaacggtaacggaccgtacgttacgtaacggtaacggtaaccgttaaaccgtacggtacggttcggacccgttacggaaccttaccgtacggttaccgtttacgttacccttaccg

SEQ ID NO: 172794 - DNA, 812 bp, Homo sapiens
  misc_feature: GYAE6OF02JGVPY.27.78.H01.1.454.CMB.1.raw
  modified_base (158)..(158): a, c, t, g, unknown or other
  misc_feature (158)..(158): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
tcagagcgtcgtctcacgaccggtgctcgatttagtgtgagtagtttgggtttggggatcttaaaagaggttctttctctgggatgtggcatgagcaaaaactgacaagtcaaggcaggaagatgttgccatcacaactcattgggtttctgctgctntgggttccagcctccgaggggtnaaattgngctgactnagtctcagactttcagtctgtgactccgaaaggacaaagtccacatcactgccggccagtcagagcgttaggtatacgacttacactggtaccagctagaagccaggtctacgtcctaccaaacgccttaccgtacaagtaccaagttactacgtaccttcccgacgtcccttcctaccggtaccggggttccccctggtaacggtcgaaggttccggacgtacggtacggtaacgtccgttaaggggaccttaactaacgttttacccaacccccgtactaaccctaattaccgtaaagttaaccgacccgttaaggaaacggtccgttaaaggtaagacgttagaccggttacgtaaaccgtaaactttaacgtttaaccgtaccgtttaccgaactttaaaccggaacggttaaaccggtttaacccgttttaaacccgtttttaacccgtaaccggtaaaacggttttacccggtaaccgtttaaccccgttaaaccccgttttaccccggggaaaaccccgggttaaacccgggggtttaacccgtaaaaccccggggttaacccggttaaccgggggtaaaagttttaaaacccgttaaaaaacccgggg

SEQ ID NO: 172795 - DNA, 564 bp, Homo sapiens
  misc_feature: GYAE6OF02IBOAM.27.78.H01.1.454.CMB.1.raw
  modified_base (198)..(198): a, c, t, g, unknown or other
  misc_feature (198)..(198): n is a, c, g, or t
  modified_base (387)..(387): a, c, t, g, unknown or other
  misc_feature (387)..(387): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactccaaaagganaaagtcaccatccacctgccgggcagtcagagcgttggagtagcttacacgtggtaccagcagaagccaggtcagtctcaaaagctcctcatcaagtatgcttccatccttctcacggggtcccctcgaggttcagtggcagtggatcgtaggacacgtattcaccctacaccatcaaatgcctagganctagaagatgtcgtagactaaacttattactagtctaatctagtaacgtaacttaccttttaaccgtactaagtgaacttaccgaaccttccggaacaaacgggtacaacgacgttaggagtaaacttaaacgtaactgttacggctacgaccaacctacgtcttacgtacttaccg

SEQ ID NO: 172796 - DNA, 866 bp, Homo sapiens
  misc_feature: GYAE6OF02GAQQF.27.78.H01.1.454.CMB.1.raw
  modified_base (149)..(149): a, c, t, g, unknown or other
  misc_feature (149)..(149): n is a, c, g, or t
  modified_base (571)..(571): a, c, t, g, unknown or other
  misc_feature (571)..(571): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccgaggggtnaaattgtgctgactcagtctccagactttcagtctagtcgaccttaccgaaaaggagaaagttccaacctaactccaccgtcggcccggccagtacgaggacgtcggttaggtagtacgtaccttacacgtggtaccgtagaccaggaacgccgtaaggtcgagtacctaccgaaaacgtccctcccgtactaacgtacaaaggttaactcgtacccttcctaccgtttacccgtttcgtaccggtacccggggtttccccccttaccgggttaaccggttttaccgaacggggtttcggtaacgtaacggggttcgggtttaacgtaccgggttaccggggtaaaccttaccggttaaaccttttaccccgtaaccccgttaaccctaaacccgtaaaccttaaccgtaaaccggttaacncccggtttaaacgggaaccgttacgtaacggtaaacgtagttacggtccgttaacggaccttaaacgtttaaccgtttacgtaccgttctaattaaccgaacgtaactttaaccgttaacctttaacccttacgtaaacgttcgaaccgtttaccctaacccgttaaccgggacccgtaacggtacccgtaaccgttacggaggggttaaaccgtaaacttaaaacgggtaaccttacggttacggtaccggttaccgaccttaaccggttacttccggttagttttaaccccgg

SEQ ID NO: 172797 - DNA, 703 bp, Homo sapiens
  misc_feature: GYAE6OF02HTBZG.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctcgtggtcagcctcgagggtgaatgtgctgactcgagtctccagtactttcgagtctgtacgacctacgaaaaggagaaactcaacactcacgtcgccggcagtcagtagtcgttaggtagtacgcttacgacgtacggtacacgacgagaacgccgtagtctcgtacgtaccaagtcctaccgtctaactaacgtaagtacgtaccttccgttaccgtacctttccgttacgtacccgtaaccggttccccgttagtacggttcaggttggcgtagagtacgtacgtacggacttaacgtacttaccacccgtacaacctacgtaacgtagtacctacgttaacgaacgtagttaaagaacgtagtacgtacgacgtaaacttaacgttacttacgtacgtaacacgttaaccgagttaccgttaaaccgttacctttacaacggtacgttaactaactacccgttaccggttacggaaaccgtaacggtaccgaacggtacggtaaaggtaacggttaaacgtaccggtacgtaacgtacgcgtaccgttaacacgttacgtacggttacttaccg

SEQ ID NO: 172798 - DNA, 839 bp, Homo sapiens
  misc_feature: GYAE6OF02H4WWC.27.78.H01.1.454.CMB.1.raw
  modified_base (182)..(182): a, c, t, g, unknown or other
  misc_feature (182)..(182): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtanaaattgtgctgactcgagtcctaccagtactttcagtctgtacgacctaccgaaaggagaaacgtccaaccatccgaccgtcggcccgggacagtcaggacgtcggttaggtaagtacgtacttacgacgttacggtaccagtacaacggaacggaccgtaggtactacgtaccttaccgaaaacgcctaccttacaacgtaaccgtaaagttactaccgtaccctttaccgtaccgtttaccccgttcgtacccgggttaacccgggttccccgttacgggttacggttaccggacgggttcgacggttaacgggttcggtaacgtttccgggtaacgggtacctaacggttaccctttaccccgtaacccccgtaaccaaccgtaacgttaacgtaaacgtaccggtaaccggtaagggtaccgtaacggtaagtaacgaacgttcgaaccggttataaccgtttaaacgtttactttaccgtacttaaccgtgtaaccggtaacgttaaccgtttaaccctttaaccgtttaaccgttaacgttaaccggttaacgtaacccgtttaccggttaccccggttaaccggaacccggttaaccggaaccggtaaccggtaacggtaacgggttaaaccgttaacgttaaacccggg

SEQ ID NO: 172799 - DNA, 629 bp, Homo sapiens
  misc_feature: GYAE6OF02GN5YF.27.78.H01.1.454.CMB.1.raw
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtcctccagactttcagtctgtgactaccaaaggagaaagtcaccatcacctgccgggccagtcagagcgttaggtagtacgcttacacgtggaccagcaagaagccaggtcagtctaccaaagctcctacactacaacgtatctccttcccacgttccttcttcgaccgggggttcccctggtacggttcagtcggcgagtcggatcgngggaccactnttccaccgtccaacctactacaattacgaccgtggaaacggctagaaacgtgtcgtctacgacttaacctttattaccgttcgntaacgtacgtaagtaacttaccgtttaaaccgtttacctacctaagttcgtattaccgttacccgttacggaccgaagaccgaaccgtacgttaggaacgtaacgttaaaccgtacgtcgttacggactacgcctaacctagtaccgtttgtccttaacccg

SEQ ID NO: 172800 - DNA, 766 bp, Homo sapiens
  misc_feature: GYAE6OF02G2RPR.27.78.H01.1.454.CMB.1.raw
  modified_base (151)..(151): a, c, t, g, unknown or other
  misc_feature (151)..(151): n is a, c, g, or t
tcagagcgtcgtctcacgaccggtgctcgatttagtgtgagtagtttgggtttggggggcatgagcaaaactgacaagtcaaggcaggaagatgttgccatcgacaactcattgggtttctgctgctctgggttccagcctccgaggggtnaattgtgctgactcagtctccagtactttcagtctgtagactccaaaggagaaagtcacatcaccgtggcccgggacagtcaggagtccgttaggtagtcgcttacgacgttggtaccagacagaacgccgaggtcagtctacaacgtctcctcatctaagtctcgtccttccgtagttccttgtccgaccgggttcccctaggtaggttccaggtcggtacgaggttcggggacttccggtacgggtaacctaaccgttacctttaccgaaccccgttacgtaaccctagttaaccgtaaacggttaccggtaccgttacgggtaacgttaccgttaaagggaacgttacgtaggtaccgtacggtaccttaaaccgttttgttaaccgtcggttaactaccgttacggaaacgttaccgtttaacccttaccgtttaacccgttagaaacgtttcggtaacttaacccggtacccggtttaacggaaccggaaaccgggtaccgtaccggttaacggtaccgggtaaacggttaaaaccggttaaacggtacggtttaccgtaacgggttacgtacccggtaacctaaccggtaacgtttccgtagtttaccc

SEQ ID NO: 172801 - DNA, 894 bp, Homo sapiens
  misc_feature: GYAE6OF02H5HW1.27.78.H01.1.454.CMB.1.raw
  modified_base (191)..(191): a, c, t, g, unknown or other
  misc_feature (191)..(191): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctcgtgggttcagcctccgaggggtgtaaattggtgctgactcgagtcctccagtactttcagtctgtnactacgaaaggagaaacgtcaccatccaccgtcggcccgggcctagtcgaggtacggtcggtttaggtagtacgtctttaaccgacgttacggtaaccctagggaccaaagggaaacgcccgtaacggggttaccaacggttacccctaacccgtaaaacggtcccttaacccctacgtaacttaccgaaaggtttcgtacggttcccctttacccgtaacggttttcccctttaccggttacccgggtaccccgggggtttccccttacggggtacggttccggtacgggtacgggtccgtaagggttaggtaacgtttcgggaacgggttaccctaaccgttaccggttttaccccaaccccttacccgtaaaccgttaactaccccggtaaaggttacccgtacccgggtaggtaacgtaccgtagggtaaacgtacggttacgtacgtaacgtaacctttaaaccgttttagttaaccgttagttacaacgttaacgtaacgttaaccgtttaacttttaacccgttaacttaacgtaacggttaccgtaacgtttacccgtaaccgttaaccggggtaaccgtaaaccggggttacttaccgggaacggttacgggtaaacgttaaacgttaaacccgggttaggtaccgttcgttaacgtccggtaccctacgtactttccggttacttccgttacg

SEQ ID NO: 172802 - DNA, 680 bp, Homo sapiens
  misc_feature: GYAE6OF02FLPL7.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgactaccaaaggagaaagtcaccatcacctggccgggccagtcagagtcggttggtagtagcttacacgtcggtaccagcaagaacgccgaggtcagtcctaccaaagcctcctcatacaagtatcgtccttcccacgttccttcgtccgtaccggggttcccctacggtacggttcgaggtcggtcgtaggtaggtacgtcgtcgggactactactttcccgacccctccaacctaactactaacgtacgaccgtaggaacgtcgtaaggaacgtactcgctacggtaccttaaactttacgtttaccgttgtactactaacgtaacgtaacgttaaccctttaccttaccgtacgtacgtacctacgttacccgtaccggttaccggtaaccggaacggtaccaaccggtacgtaagggtaaccgttaaacggttaaccggtaacgttcggtacgtcgtaacgccctaacgttactcgttacgttccttaaccg

SEQ ID NO: 172803 - DNA, 878 bp, Homo sapiens
  misc_feature: GYAE6OF02I75XX.27.78.H01.1.454.CMB.1.raw
tcagagcgtcgtctcacgaccggtgctcgatttagtgtgagtagtttgggtttggggggcatgagcaaaactgacaagtcaaaggcaggaagatcgttgccatcacaactcattgggtttctgctgctctgggtccagcctcgaggggtagaaattgtgctagactcagtctccaagtactttcagtctgtgactccgaaaggagaaagtccaccactcgaccgtcggcccgggacaggtcacggtaggtcgtttagggtacgtaagtccttaacgacggttacggtacccaggtaccgaagaacgccgtaaggtaccaaggtacctacccggtaaaagtccctacccgttacctaacgtacgtaaacggttactaccggttacccgtttaccccgacggtttcccctttacgtaccccgggtaacccggggttccccccgttacgggttacgggttccgtagggttcggccgtaagggttcgggtaacttcggtacgggaactacgttcgtttaccccgaccgttaccctaacccacgttaaccgtaaacgtaccggtacccgtaacgggtagttacccgaaggtaacggtaactccgggattaccgttaaacgttaacttttaaccgttacgttaccggttaactaccgttaacgtaacgttaaccgttaaccttttaacctttaaaccgttaacgtaacggttttacgaacctttaacccggtaccggttaccgaaccgggttaaaccgggacttaacccggtaacggtacgggtaaaacgttaaccggtttaaaaaccggtacgggtttaacgacccggggtttaaacgttaccgaacccgtaaccgtttacgttacccggttaggtttacccc

SEQ ID NO: 172804 - DNA, 598 bp, Homo sapiens
  misc_feature: GYAE6OF02FYLZF.27.78.H01.1.454.CMB.1.raw
  modified_base (205)..(205): a, c, t, g, unknown or other
  misc_feature (205)..(205): n is a, c, g, or t
  modified_base (573)..(573): a, c, t, g, unknown or other
  misc_feature (573)..(573): n is a, c, g, or t
  modified_base (591)..(591): a, c, t, g, unknown or other
  misc_feature (591)..(591): n is a, c, g, or t
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaagtcacntcacctgccgggcagtcagagcgttggtagtagtcttacacgtcggtaccagcagaacgccgaggtcagtctaccaaagcctcctcatacaagtactcgtccttcccacgttccttctccgacgggttcccctcggtacggttccaggtcggccgtaggtggtatcggtcgggactactatttcccacctccgacctactaccatacgccgtaagggaacgtctagaagtactcgactacgacgttaacttattacgttgtacaacttcgtagtaacgttaccttaactttaccgacttagtactcgtacttaccgtcgaccgacggactacgtacgtgaacgtaagtaaccagtagtacggtgtacnccgtaacgtctaccgttntcttacc

SEQ ID NO: 172805 - DNA, 755 bp, Homo sapiens
  misc_feature: GYAE6OF02IDC16.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaattgtgctgactcagtctccagtactttgagtctgtacgactacgaaggagaacgtcacatcgacctcggccgggaccagtcgagaggtcgttaggtaagtcgtacttaacgacgtcggtaccgagacgaggaacgccgaggtcgacgtactaccaacgtcctacctactatactaagtatacgtccttaccctacgttccgttcgtccggtacccgggttcccgtacggttacgggttacgtaggtacggtcgtaggtacggtagtcggtacggtaccgtacttaacgtttcccaacccttaccgtacctactaccgtaacgttaccgtaccgtagggtaacgtacgtaaggtaacgacgtacggtacgtcgtaaactttaccgttttaagttaccgttacgttacctaacttacgtaacgttaaccgtttaaccgtttaaccctttaccgtaacgtacgtacgtaccgttacccggttaaccgttacccgggaacggaacgggtactaaccggtacggtaacggttaacgtaaacgttaaccggtaacggttgtacgtcggtacctacgtaaccgttacgttaccgttcgttaccgtttcccg

SEQ ID NO: 172806 - DNA, 670 bp, Homo sapiens
  misc_feature: GYAE6OF02JDTME.27.78.H01.1.454.CMB.1.raw
tcagagcgtcgtctcacgaccggtgctcgatttagtgtgagtagtttgggtttggggtagtcttaaaagaaggttctttcttctgggatgtggcatgagcaaaactgacaagtcaaggcaggaagatgttgccatcacaactcattgggtttctgctgctctgggttccagccctccgtaggggtgaaattgtgctgactcagtctccagtactttcagtctgtgactaccaaagggaagaaacgtccaccatccaccgtcggcccgggccagtcaggagcggttggtagtagcttacactggtaccagcagaacgccgaggtcacgtccaccaaacgcctcctcactacaagtagtactctcccacgttccttcgtccgtaccggggtcccctcggtacggtttcgacgtggcagggtggactcggtacgggactactatttaccgtaacccctaccaccctaactactaaacgtaccgtacccgtagggaacgtaccgttagaacgtagtcgacgttacacgttaaacgtttacttaacttacgtactatacgtaacgtacgttaaccttaacctttaccgtaactaacgttacgtaacttaccgtaacccgttaccggaacccgtaagggaccgtaaccggacgtacggtaacgtaagttaaaccgg

SEQ ID NO: 172807 - DNA, 676 bp, Homo sapiens
  misc_feature: GYAE6OF02GE9JA.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagactttcagtctgtgacctaccgaaaggagaaacgtcaaccatacaccgtgcccgggccagtcagacggtcggtttaggtagtacggtcttacgacgtacggtaccaggcaacgaaggccaaggtcaggtcctaccaaatcctacctcactaccaagttactcgtccttacccagttcccttctccggaccgggttcccctaggtcgttcgacggtcggacctaggtggagtcggtacggaacctacgttactttccgaaccctcgacctaactacgaactcgaccgtaggaacgtctaagagtacttggactacgtacctaatttacgttacttcgtacactacggtaatacgttaacctttaacttaccctacgttagtactacgtaccctttaccgtaccggtaccgtaacgggaactaccgtacgtacggaacgttaaacgtaaacggaaccgttgggtacggtactaccggacctacgtacttcccttagtccctttaccg

SEQ ID NO: 172808 - DNA, 640 bp, Homo sapiens
  misc_feature: GYAE6OF02H0QJZ.27.78.H01.1.454.CMB.1.raw
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (526)..(526): a, c, t, g, unknown or other
  misc_feature (526)..(526): n is a, c, g, or t
  modified_base (608)..(608): a, c, t, g, unknown or other
  misc_feature (608)..(608): n is a, c, g, or t
tcagagcgtcgtctcacgaccggtgctcgatttagtgtgagtagtttgggttggggatgagcaaaactgacaagtcaaggcaggaagatggttgccatcacaactcagttgggtttctgctgcctcgtgggttccaggcctcgaggggtgtaaattgtgctgactacagtctccagtactttcagttctgtgactacgaaaggagaagcacacncactgccgcagtcagngcgttggtatagtctacnctacggtaccagcagaanccgaggtcncgtctacgaagtcctctactacgnaacgtatcgtcctccgacttctcgacgcgggtccctggtcggtcaggtcgactaggtcgtagtcgtacggactacgttcttacccgacctacgacctagtacaacgtacgtcgaggtaacgtcgtaacgatagtcgtcctaacgtaccgtaactttaagttaccgtaacgttcaacttacggtaacggttaaccttaaccgtttaactttaacccgaagttacgtanaacccgttccctaacggttacggaccgtaaacgggtacctacggttacgggtttaaccaagtttaacgacgttcggaccgtntaccggactaacctcggttactcttacgtacc

SEQ ID NO: 172809 - DNA, 794 bp, Homo sapiens
  misc_feature: GYAE6OF02H8WVY.27.78.H01.1.454.CMB.1.raw
  modified_base (148)..(148): a, c, t, g, unknown or other
  misc_feature (148)..(148): n is a, c, g, or t
  modified_base (168)..(168): a, c, t, g, unknown or other
  misc_feature (168)..(168): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtanaaattgtgctgactcagtcnccagtactttcagtctgtcgactacgaaaggagaaacgtcaaccactaccaccgtcggcccgggacctacggtcacgggtaggtcggtttagggtaggttacgtcctttaaccgtacgttacgggtaacccagtaccaacgggaacgacccgtaacgggtccgacgtacccgtaacccaaaggtccccttaccctacaacttacgtaacgttacttcggttacccctttacccctagttccccttacgtacccggtaccggggttcccctacgggtacggtttcgaggtcgggtaccgaggttcgggacttcggtacgggaaccttaccggttacttcccgtacccctactaccttacggtactaacgttacggtaccgtagggtaaccgtcgtagggaaacgtgttaccgtacgtactaacctttacctttaacgttaacgtcgttacgtactacgttaaacggtactttaaccttaaccgttttaaccctaataacggttataccttaccgttacccggttaaccggaccggaaacggacgtacgtcggtaacggaatttaaacgtaacggacgttaggtaccgtactacggtacctaccggttacttcgttactcctttaccg

SEQ ID NO: 172810 - DNA, 691 bp, Homo sapiens
  misc_feature: GYAE6OF02I6XIF.27.78.H01.1.454.CMB.1.raw
  modified_base (146)..(146): a, c, t, g, unknown or other
  misc_feature (146)..(146): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (446)..(446): a, c, t, g, unknown or other
  misc_feature (446)..(446): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtnaaattgtgctgactcagtctccagtactttcagttctgtagactacaaaggagaaagtcaccagtccacctggccggccagtcagagcgttggatacgcttanacgtgtaccagcagaagcaggtcagtctaccaagctcctntactacaacgttagtcgtaccttcccgtacgttcccttcgtcccggtaccggggtcccccttggtacggttcacggtcggacgaggtcggacttcggaggtaacacttacttccaccctacacctacgtacactacgtcgtagacgtcgtagaagtntcgtacgtcgtaacgttaactttacttactcgttactactacgtaacgttacctaactttaactttacctaacgttaagttcgtaaactttcccgtaaccggttaaccgggacccgtaaaacgggtaccgtaaccggtaccgtttacgggaacgttaaaacccggttaaccggttaacgtaacggttcgtacccgttacggtacccgttaaccgtacccgttttacgtaccgttacctttacccg

SEQ ID NO: 172811 - DNA, 791 bp, Homo sapiens
  misc_feature: GYAE6OF02FLZH4.27.78.H01.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcacaactcagttgggtttctgctgctcgtcgggttccagcctccgagggtntaattgtgctgactcngtcctccgatactttcagtactgtcgtaacctacgaaaagggtagaaagtccaccactctaccgcggccggaccagtacagtacgtgttggtagtacgtacttacacgtggacctaggtacaagaacgaccctaggaccgtacgtccgtaccaaacggtcctcccgttactaacgtacgtaaacgttacgttacggtccttaccgtacgttacccttccgtacgttaccccggggttacccttcggtacggtttacgacgggtacggtacgttagggttaggtacccgtacggtaccggggtaaccttaaccgttacctttaacccgaacccccgttaactacccgtaacgtaaaccgttaaacgttccggtaaccggtacgggttaaacaccggtaagtaacgtaacgtcggttaacgtccgttaaaccgttaacgtttaactttaccgtttacgtacctaagttacctaacggttaaccgttaaccgtttacttaccttacgtaacgtcgttaccgttaaccgtaacccggttaaccggaccgtaacgggtaacccgaaggttaacgacggttaacgaacgtttaaacgg

SEQ ID NO: 172812 - DNA, 621 bp, Homo sapiens
  misc_feature: GYAE6OF02F130L.27.78.H01.1.454.CMB.1.raw
  modified_base (145)..(145): a, c, t, g, unknown or other
  misc_feature (145)..(145): n is a, c, g, or t
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttcagcctccaggggtnaaattgtgctgactcagtctccagtactttcagtctgtgactaccaaagganaaagtcaccatcaccgtggcccgggcagtcaggagtcgttggtagtagcttaacacgtggtaccagacagaagccaggtcagtcctacaaacgtcctcctcactacgaagtntcgtccttcccgagtcccttcgtaccggtaccggggttcccctggtacggttcgaggtcggcgtaggtggactcggtagggtactactactttccaccctccaacctatacaactacgtcgtaggacgctaggaagtagtcgtctacgtactaacttacttacgttctactatacagtacttacttacttacgagtaacgtatacttacgttaccgtcgacggtaacggacctacgtacgtaggtaacgtaaacgttaaacggtacgtggtacggtactacgtactaccgtattaccgttcgttccttaccg

SEQ ID NO: 172813 - DNA, 917 bp, Homo sapiens
  misc_feature: GYAE6OF02GJ8QH.27.78.H01.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcanaactnattgggttctggctgctcgtgggtccagtccgtcgaggggtntaaattgtgtctgactcacgtcctaccagtacttcagtctgtcactacgaaaggacgaaagtcaacctatccgaccgtcggcccggtacagtcgaggtacggtcggttaggtagtacgtaccttacgacgtaggtaccacgacgaacggtaacgtccgtaggtacctagtaccgtaaccgtaacgtccttcctactacgtaactaaggttactaccggtcctttaccgacgtttaccgttccgtaccggttaccggggtaccctacgggtacggttcgaagggtcggtacgtacgggttacggtacgtttccgggtaacgggtaacccttaacgttacccgttttaccccgaaccccgttaaccgtaacccgtaacgttaaccgttaaaccgggtttaaccggacccggttaaggtaaaccgtacgggttaaacggtaaccggttacgtacggtaccggtttaaaccgttaaaccggtttaaacctttaaaccgttttaccgggttaaccttaccgtttaaaacgttaacccggttaaacggttttaaccccgtttaaactttaaccccggtttaaccgttaacggtaaaccggtttaacccgttaaaccgggtttaccccggttaaacccggtttaacccggggtaaccggtaaacccggggttaacccgtttaaaccccggggaacggttttaaacccgggttaaaccggttaaacccggtttaaaacccgggg

SEQ ID NO: 172814 - DNA, 998 bp, Homo sapiens
  misc_feature: GYAE6OF02FOHST.27.78.H01.1.454.CMB.1.raw
  modified_base (148)..(148): a, c, t, g, unknown or other
  misc_feature (148)..(148): n is a, c, g, or t
  modified_base (187)..(187): a, c, t, g, unknown or other
  misc_feature (187)..(187): n is a, c, g, or t
tcagagcgtcgtctcacgaccggtgctcgatttagtgtgagtagtttgggtttgggggatgagcaaactgacaagtcaaggcaggaagatgttgaccatcacaactcattgggtttctgctgctctgggttccacgcctccaggggtntaattgtgctgactcagtctccagtactttcagtctgtnactacgaaagagaactcactatccacgtcggccggaccagtacaggtacgcggttaggtagtacgaccttacgacgtacggtaccagcgaacgtacgccgtaaggtctacgtacctaccgaaacgtcctacctactactacgtaagttactcggttacccttacccgtacgttaccccgttacgtacccggtaccgggggtttaccccctacgggttaccgggtttacgttacggttccggggtacggtacgggttacggtaccgttaccgggttaccggggtaaccttaacggttacccttttacccgtaacccccgtttaacgtaccccgttaaacgtaaccgttaaaccggttacggtaacccgtttaacgggttaaaccggtacccggttaaacgggtaaacgttacggttaaccggtaccggttaaacggttaaacccgtttaaacccggttttaacctttaaacgggtttaccctaccggtttaaaccgttaaccgggtaaacggttttaaacccgttttaaccggttttaaaccccgttttaaccggttaaacccgtttaaaccgggtttaccgtttaaaccggtttaaccccctttaacccggggtttaaacccggggtaacccggttaaaacgggttaaaccccgggtaaccggtttaccggttaaccggggaaaccggttttaaccggttaaaaacccggtaccggttaacccggggttacggtaaccggttaacccggttaacccgttaaacccgttacctttacccgggggtttttacccttacggtttaaccccccgg

SEQ ID NO: 172815 - DNA, 662 bp, Homo sapiens
  misc_feature: GYAE6OF02GQV84.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgactaccgaaaggagaaagtcaccatcgaccgtcggccggcagtcgagaggtcggttggtagtagtccttaacgacgtacggtaccagcaagagccgaggtcagtctaccaaagcctcctacactacaaagtatcgtaccttcccagttcccttccgtccggtaccgggtccccgtacggtacgttcgacggtgacgtaggtggacgttcgtaggacctacgttacttacccgtaccctacaacctactaccaacgtacgtaccgtaggaacgtcgtaagaagtacgtacgtactacgtactaaacttacgttacgttacgtactacgtacgtacgtaacctttaaccttaaccgtttaccaacgttacgtacgtaccttacgtaccgtacgaccgtaacggtaccagtacgtaggtaacgtaacgtaaaccgtacggtacgtacgtcgtcgactaccgtgtacgttcgtacttaccg

SEQ ID NO: 172816 - DNA, 733 bp, Homo sapiens
  misc_feature: GYAE6OF02IF5WN.27.78.H01.1.454.CMB.1.raw
  modified_base (184)..(184): a, c, t, g, unknown or other
  misc_feature (184)..(184): n is a, c, g, or t
  modified_base (234)..(234): a, c, t, g, unknown or other
  misc_feature (234)..(234): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcaacaactctatttgggtttctgctgctcgtgggttccagcctcgaggggtnaattgtgctgactcagtctccagtactttcagtctgtgactacgaaaggnaaagtcaccatccaaccgtggcccggactagtcaagtacggtacgtttaggtagtacgtcttaacacgttacgtaaccagacgaacgaacggtaccgtaagggtacctacggtactaaccgaaacgtccttacccgtataacgtacctaaaggttacgtccgtacccttacccgacgtttccccgttacgtccggtaccgggtccctaggtacgttcgaggttcggacgtaggtaggtactacggacggtactacgttactttacccgaaccctacctaaccgtaactacgtaacgtacgtaccgtaggaacgtacgtaacgaacgtcgtcgtacgtacgtaaaccttaacgttctaacgttcactaacgtactaagtaaccgttaacctttaccgttacctacggtaacgtcgttaaaccgttaccctaacccggttaacgaacccggtaacggaaccgtaaccggttaagtaaccggtaacgttaagttaaacccgg

SEQ ID NO: 172817 - DNA, 742 bp, Homo sapiens
  misc_feature: GYAE6OF02FUWPC.27.78.H01.1.454.CMB.1.raw
  modified_base (147)..(147): a, c, t, g, unknown or other
  misc_feature (147)..(147): n is a, c, g, or t
  modified_base (266)..(266): a, c, t, g, unknown or other
  misc_feature (266)..(266): n is a, c, g, or t
  modified_base (709)..(709): a, c, t, g, unknown or other
  misc_feature (709)..(709): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggggtnaaattgtgctgactcagtcctccagtactttcagtctgtgactaccgaaaggagaaacgtcaccataccaccgtcggcccggcagtccaggacggtcgttagggtagtacgtcttaacncgttacggtaccagcaaggacgaccaggtctagtcctaccaacgcctcctacatacaagtactcggtccttacccgacggttccttcgtcgggtaccggtcccctggtacggttcgaacggtcggacgttaggtcggtaacgttcggtacgggaacccttacgttaacttttaccccgaacccttacccaaaccgttaacttacccgaacgtttaccggaccgtttaaacgggacgtacggttaagaacgttgttacgacgttaccgtaacctttaacgtttaaacgttaccgttgtaccttaaacgttacgtaaacgtttaaccgtttaacctttaaccgttttaccgaacgttacgtacgttaactacccgttaccgtaccggtaacgtaaccggacgtaccgtacgtaggaacgtaaccgtaacggtacgtaggttacgngtacctactacgtagttccgtacttaccttacg

SEQ ID NO: 172818 - DNA, 875 bp, Homo sapiens
  misc_feature: GYAE6OF02JB00T.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgtctcgtgggttccagccctccgaggggtagtaaattgtgcgtagactcacgtcctaccacgtactttcatcgttgtgacctaccgaaaggaagaaacgtaccaccacgttccaaccgtcggaccccgggccaggtaccgaagacgactaggttaggtaacgttagtaccttaccgtacgttacgggtacccagacgaaggaaaccgcccggtaggtacgtacgttacctaaccgaacgttccctacctactactaccgtaagtaccttacggtcccttacccgtacgtccccgttcgtcccggtaccgggtccccgtacggtacgtcgtagtcggacgaggtacgtacgtcggtacggtaactacgttaccgtttacccacccgttaccctaacctacgttaccgtaaacgttaccgggtacccggttaaggaaaccggttacgttaacggtaacgtacctacgggttcccgttaaggtaaacccgttttaaacgttttacttaaccggttaccgttaaccgtaaacgttacgttaaaccggtttaacccgttttaacccgtttaccttttaaacccgggttaaccgtaagggttttaacccgtaaccccggtttaaccccgttaccccgggtttaaaccgggaccccggtttaaaaccgggggtaaacccccttaaccgggtttaaccgggttaaaccgggttaaaggttaaaaacccgg

SEQ ID NO: 172819 - DNA, 685 bp, Homo sapiens
  misc_feature: GYAE6OF02IKL8N.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagtactttcagtctgtgacctccaaaggagaaagtcaccatcacctgccgggacagtcgagagcgttggagtagcttacacgtggtaccagacagaacgccaggtcagtctaccaaagcctccacactcaaagttatcgtcttccctacgtccttctacgtaccgggtcccctaggtacggttcaggtcggcgtacggtggactcggtagggtacctacgttatttacccgacccctacgtaacctaacgtctaaacgtacgtaccttagggaacgtaccgtaggtaaacgtaacggttcgtacctacggtaaccttaaaacgtttacgttttacgttacgtacctaacgtaccgtaaagtaacgtttaaccctttaactttaacccgtactaaacggtacgtaacttaccgtcccgttacggaaacccgtaagggacctacggtacagggttaacaacgttaaacgtacgtaggtaccgtagtacgtaccgaaccttacttcgtaccgtcttaccg

SEQ ID NO: 172820 - DNA, 691 bp, Homo sapiens
  misc_feature: GYAE6OF02GXDV6.27.78.H01.1.454.CMB.1.raw
  modified_base (200)..(200): a, c, t, g, unknown or other
  misc_feature (200)..(200): n is a, c, g, or t
  modified_base (660)..(660): a, c, t, g, unknown or other
  misc_feature (660)..(660): n is a, c, g, or t
tcagagcgtcgtctcacgaccggtgctcgatttagtgtgagtagtttgggtttgggatgagcaaaactgacaagtcaaggcaggaagatgttgccatcacaactcattgggtttctgctgctctgggttccagcctccgaggggtagtaaattgtgctgactcagtctccagtactttcagtctgtgactacgaaagganaagtcacataccacgtcggccggacagtcagagtcgttaggtagtacgcttacgacgtacggtaccagacaagaacgaccgtaaggtcacgtacgtaacctaaacgccttcctacaactacgaaggttactcgtaccttacccgtaccgttaccctttccgtaccggtacccgggttccccctacgggttacggtttacgtacgggttcggacctaggttacgtaacgtccggtaggaccttaacttactttacccgaccctaccgaaccttaacgtaccgaagtacgtaccgtaaggaacgtctaaggaactgtacgctacgacttaacttacgtctaagtactatacaacggttaccttaacttaccttaacgtacgtagtctacgtaccgtaccgtacggaaccgaacgtacgacgtacggtaagtaacgtaaccggtaaagtcgtgacggtaaccnggaccctaagtacctgttacgtaccttaccg

SEQ ID NO: 172821 - DNA, 714 bp, Homo sapiens
  misc_feature: GYAE6OF02G8FV2.27.78.H01.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtnaaattgtgctgactcagtcnccagtactttcagtctgtgacctacaaagganaaagtccaaccataccaccgtggcccggcctaaggtccagacggtcggttaggtaagtacgtcctttaacgaccgttggtacccagccaagaacgccgaggtcagtcctacaaacgcctcctcactacaagtatccgtccttacccgacgtttccttacgtcggtaaccggggttccccctaggtacggttcacggtggtacgaggttgggactcgtacgggactaacgtctttacccaccttacaactatacgactacgttacggacggaactggtaacgaagacgttcgtaccgtactaaacgttaccgttattaccgttcgtaaactctaacgtaagtaccgtttaactttaaccgtttacaacgttaacgtacttaccgtaccgttacccgtacggtaccgtaaacgggcctaacgggttactaaaggtaccgttaaacttaaacgggtcgttacggtacgggtcttaacgtaccgtactttaccggtacggtttcccttaactttcccgg

SEQ ID NO: 172822 - DNA, 747 bp, Homo sapiens
  misc_feature: GYAE6OF02JAOFH.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttcgccatcacaactcattgggttctgctgctcgtgggttccagcctccgtagggtagtaagttgtgcctagactcgacgtcctcacggtactttcgagtcgtgtcgaccgtacgaaaggaagtaacgtacaacctagtacctacccgttaccgggacctaggtccgaggtacgtccggttagtaggtacgtcttacgacgtggtaccagtacaagacgacgtaggtccgacgttccaacggaactctaccctgtaacgtacctaagacgttcgtacccgttaccgtacgttcccgttaacgtaccggtaccgggttaccccgtaggttaaccggttacgtacggtacggtacggttacggtacgggtcgttaccggtacgggtactaaccgtaccgtttacccaacccgttacaactacgaactacgtacggtacgtaagtactacgtaaggactacgtacgtctaacggttaacttaacgttacgttaactagttaccgtacgtaacgtaacgtacggttaacctaaccttaccgtacgtaacgttacgccttacggtaaccgttacgaaaccgttacgaccgttacggtagtaacggtaacttacggttaaaccgtacgg

SEQ ID NO: 172823 - DNA, 766 bp, Homo sapiens
  misc_feature: GYAE6OF02I9751.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccagggtgaaattgtgctgactcagtctccagacctttcagtctgtgacttccaaaggagaaaagtccaccatccacctggccggccacgtcagtacgtcgttacggtagtagtccttacgactcggtaccctaagcgacgaacgccgtaggtacacggttacctacccgaaaacgtcctcccgttaccaactaccgaaagttacctcgtcccgttaccctaagtttccccttcctccgtaccgggggttccccccgtagtacgggtttaccaggttacgggtcgaacggttggacttcgtacggtacctacgttacgtttacacccctcaaccgataacctaagtacgaccgttaggaaacgtcgtaagaagtacggtctaactgaacgttaaccttacgttacgttaacgtaccgttaactaccgttaaagtaacgttaacctttaaaccgttttaaccgtaccgttaaacggttacgtaccgttaacccttaccccgtttaccgggtaaccggaaacgggtaacccgtaaccggtaactacgggtaagtaaacccggtttaaactaaccggttagtcggtttaccgcggtaccctaccgttacgttacttacgtttaccttaaccg

SEQ ID NO: 172824 - DNA, 1040 bp, Homo sapiens
  misc_feature: GYAE6OF02HZMJ0.27.78.H01.1.454.CMB.1.raw
tcagagcgtcgtctcacgaccggtgctcgatttagtgtgagtagtttgggtttggggggcatgagcaaaactagacaagtcaaggcaggaagatgttgcatcacaactcattgggtttctgctgctcgtgggttccagcctaccgtaggggtagtaaagttgtcgtctacgtactcgagtcctccgtaacgtacttttacgagttcgttgtacggtaacctaaccggaaaagggtaagaaaggttacccaacctaactaccaccggttccggccgggacctacggtacgaaggtacgggttcggttacggggttaagtacgttactttaaacccgtacggttaccggttaaccgaacggaacgaacgggaaacgtaccggacggtacgaccgttacctaaaccggaacgtcctaccctacgaactacgtaaacggttcgtaccgtccgttaccccgttacgtttacccggttacccgtttcccggggtacccggggttttaccccttacggggtaccggtttaacaccggggttccggaccggtaggttttaacggggaccgttttccgggtaaccggggttaaccttaaacccgttaccgttttaaccccccctaacccgttacccgtaaaccccttaaacggttaacccttaaacggggtacccgtttaaccgggttaacggggtaaaaccggttaaccgggttaaaggtaaacggttaacgtaaccgggtttacgtttaacgttaaacccgttttaaacgttaaacccgttttaccgtttaacgttaaaccgtaccgggttaaaacttaaccggtttaaacggttttaaccctttttaaacccgtttacgtttaaacggaccgtttaccgtaaccgttttccgtaaccgggttaacccggttaacgggaaccggtaaccggtaacggttaacgggttaaccgtaaacggttaaaacccgttaaaggttacccggttaggtttaaccggttcgtaacccgtaccgttaaaccgtttcgtaaccgttacggtttacccc

SEQ ID NO: 172825 - DNA, 772 bp, Homo sapiens
  misc_feature: GYAE6OF02IJ3WP.27.78.H01.1.454.CMB.1.raw
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgcttcgtcgggttccacgtccgtccgaggggtagtaaagttgtgtctgactcgagtcctaccagttactttcgagttcgtgtacgtacctaaccggaaaggacgtaaacgtctaaccataccaccgtcggcccggacagtacacggtagtcggttacggtagtacgacttacgtacgtacggtaacgacgacgaacgacggacgtacggtcgtacgtctaaccgtaacgtcctacctactactaacgtaagtacgttcgtacccgttaccgtcgttacccttcggttaccggtacccgggttccccgttaaggtaccggttaccgtcgggtaccgtacggtacggttacggtacggttacggtacgggtaacccttacgtttaacccgtttaccccgtaacccgtaaccgtaaccttaaacctacgttaaaccgttaccggtaccgggtaacgttaacgtacggtaagttaacggtactacgtaccgtagtttaaacccttaagtttaccgtacgttcgtaactacgtacgtaagttaacccgttacttaccgtactagtacgtctacgtacctaaccggtacgaacgtacgactacgacggtaacgtactaacgtaag

SEQ ID NO: 172826 - DNA, 810 bp, Homo sapiens
  misc_feature: GYAE6OF02JX9WM.27.78.H01.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (555)..(555): a, c, t, g, unknown or other
  misc_feature (555)..(555): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtagaaattgtgctagactcagtctccagtctttnagtctaggtnactaccgaaaggagtaaacgtcaaccacttccgaccgtcggcccgggaccagtacgagacgtacggttaggtacgtacgtaccttacgacgtacggtaccaggacaaggaaccgtcgacggttacgacgttaccacccgtaagtcccgtacctctaacgtaactaagttacgtccgtcccttacccggtccgtcctttaccgtaccgggtacccgggttaccccgtacggtacggttacgtacggtacggtacgtagggtacgtacgttaccggtcggtaactacgtacgtttaccctaccctaacacccgtaaacgttccaaagggtttccctaacggtacggtaacgtaccggtaagtaacggntaccggtacgtacgttaactttaaccgttacgttacgttacgttactacgttaccggtaacgttaaccggtttaaccctttaaccggttaacccgtttaacgaacggttactaccgttacccgttaacccgttaccgggaaacccggttaaccggaccggttaacgtacggtaagttaacggtaacggtaaccgtacggtacggttcgtacgttaccgacgtaaccgttaccgtaccggtttactaccgttaccg

SEQ ID NO: 172827 - DNA, 877 bp, Homo sapiens
  misc_feature: GYAE6OF02IRNA0.27.78.H01.1.454.CMB.1.raw
tcagagcgtcgtctcacgaccggtgctcgatttagtgtgagtagtttgggtttggggatgagacaaaactgacaagtcaaggcaggaagatgttgccatcaacaactctagtttgggtttctgctgctcgtcgggtccacgccgtccgaggggtagtaattggtgcgtacgactcgagtcctaccgacgttactttcgagtcgtgtacgaacctaaccgaaaggtacgaaacgtaccaacctacgtaccaccgtccggacccggaccacgtaccgaggtacggttcggttaggtaagtacgtaccgttacgtacgtacggtaccagacgtaaaggacgaccgtaggtactaccgtacctaaccgaacgtcctcctactaactacgtaagtcttccgtaccttcccgtacgtttccctcgtaccgggtacccgggttccctacggttacggttacgcggacggtcgtaggtacggtacgtcggacgtaacctacttacctacccgaccctctaacctactacgacgttaccggaccgtacggtacgtacgtacgtaagtacccccccccccccccccccccccccccccccgtagtacgtacgtaacttaacgttacgttacgttacgtacgtaacgttaacgttaacgttaaccgttaaccttaaccgtttaaccgttaaccgttaacgttaccgttaacccgttaacccgttaacccggttaacccggtaaccggtaaaccggtaaccggtaaccggtaaccggttaaccggttaaaccggttaaaccggttaaaccggtaaccggttacggttaaccggtaccggtaccgtaccggtacccgttaccgtttaccgttaccgttacccgttacccg

SEQ ID NO: 172828 - DNA, 796 bp, Homo sapiens
  misc_feature: GYAE6OF02JDMJS.27.78.H01.1.454.CMB.1.raw
  modified_base (476)..(476): a, c, t, g, unknown or other
  misc_feature (476)..(476): n is a, c, g, or t
  modified_base (572)..(572): a, c, t, g, unknown or other
  misc_feature (572)..(572): n is a, c, g, or t
tcagagcgtcgtctcacgaccggtgctcgatttagtgtgagtagtttgggtttgggggatgagcaaaactgacaagtcaaggcaggaagatgttgccatcacaactcattgggttctgctgctctgggttccagcctccgagggtgaattgtgctgactcagtctcagtactttcagttctgtcgtaccgtaccgaaagggagaaaacggtccaaccgacttaccacccgtcggccccgggacctagtacgacggacgtacggttcgggtaagtacggtacttaccacgttacggtaccagtaccaaggaacgaccgaggtctacggtcctaccgaaacgtccttacctaccagttaccgaaagtcgtacgtcccttacccgtacggttcccttcgtccggtaccggggtcccttacggtacgggttcgaggtacggcgtaggagtacgtcggtacgggactacttaccgttaccnccccgtacgtaaaccctataccaagttacgcgttaagacgtattacggaaacgtctcgggtactacggtaacttaacgtttacgtttacgtacgtnttaaccggttaacgacgttaaacttaccgtttaacctttaaacctacgttaaagtccggtaaccttacccgtaaaccgggtttccgaaacccggttaacgggacccgttaaccgggtacggtaacggtaaccgtttaaacggtaaacccggtaaggttcgggtaccttaccgtaccggtaaccctaccgttaacggttcctttacccgtttacgtttaccccgg

SEQ ID NO: 172829 - DNA, 668 bp, Homo sapiens
  misc_feature: GYAE6OF02JROIJ.27.78.H01.1.454.CMB.1.raw
  modified_base (146)..(146): a, c, t, g, unknown or other
  misc_feature (146)..(146): n is a, c, g, or t
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagagcgtcgtctcacgaccggtgctcgatttagtgtgagtagtttgggtttggggatgagcaaactgacaagtcaaggcaggagatgttgccatcacaactcattgggtttctgctgctcgtgggtccagcctccgaggggtanaattggtgctgactcgagtcctccgagtacgtttcagttccgtgtcgacctacgaaaggagaaacgtccaaccgtanccaccgtgggcccgggtaccagtcgaggagtccgttaggtacgtacgtcttaacgcgttcgtaacnggacgaacgacgacgacggtcacgttacacgaacncctccanacttagaacgtctcgtcccttacagttcctagccggtacggtcccttaggtacgtcgagcgtacgacggtaggacccttggaccggtactaccttacgtcccaaccgtccaactacgactaacgtgaccgagacgtacgtagtacgtgtacgtcacgttaactaacgttacgtacctcgtacacgtacgtaacgtacgttacctaaccttactacgttacgtacgttacctaccgttaccgtaccggaacgtaaccgtacgtaaccggtacgtaggtaacgtaacgttacgtaccgtagtccgacgttacgacctacgtaccttcgtcttactaccg

SEQ ID NO: 172830 - DNA, 745 bp, Homo sapiens
  misc_feature: GYAE6OF02HXHU9.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggatgagcaaaactgacaagtcaaggcaggaagatgttgccatcacaactcagtttgggtttctgctgctctcgggttcagcctccgaggggtanaaagttgtgctgactcagtctaccgagtactttcgagttcgtgtacgactacgaaaggagaacgtcaactactaccaccgtcggccggactaggacaggacggtcgttagggtacgtacgtacttacgacgttcggaaccagactaacgaacgcgtaaggtacgacgtacctaaccgaacgtcctcctacactacgtaacgttactcgtacccttaccgtaaccgttccgttacgtaccggtaccgggtaccccgtaggttacggttacgaggtcggacgtaggtggtacgtcggaacggtcaacgttacgtttccacctactacgactaactaacgtccgaacggtaggaacgtgtaaagtaacgtacgtcggtacctaacgtaccttaaacgttacgttacgttacgttacacggtaacgtagttaaccgttaacctttaccgtttaaaccgtacgtaaacgttctaaccgttacccgtaccgttacccgggaaaacgaccggtaacgtaccgtagtacggtaaactaaacggtttaaacgcggtacggtttacgacgtacgacctaccgtagttcgtttacgtccgttaacc

SEQ ID NO: 172831 - DNA, 881 bp, Homo sapiens
  misc_feature: GYAE6OF02GPZGJ.27.78.H01.1.454.CMB.1.raw
  modified_base (235)..(235): a, c, t, g, unknown or other
  misc_feature (235)..(235): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtataaattgtgctagactcagtcctccagactttcagtctgtcgactacaaagganaagtcaccatcactcggccggacagtcagagcgttaggtagtacgtacttacacgtggtaaccagacgaaggaacgtccgtacggtctacgttaccgtaccgaaacgtccttccctacgtaactacgtaaacgtcttcgtacccttacccgtaagttcccttaccgtaccgggtaccggggttaccccctacgggtaacggtttcgaacgggttggacccgtaaggttacggtaaccgtttcggtaacggggtaacctaaacgttacccgttttaccccgaaaccccgttacctaaacccgtaaccgttaacctaaacgtacccgggtaacccgttaacgggtaaacgtacccggttaaaggaaaaccggttaacgttaaccgggttccggttaacggtaaaccccttaaaaacgttttacccggttttaaacgttcgggttaaccttaacccgttaacgtaaaacggtttaaccgggtttaaacccctttaaaccgttttaaccccgttaataaaccgggtttcgtaaaccccgtttacccggtttaaccccggtttaaacccggggacccggttaaaacgggggaacccttaaaccgggaaccggttttaacgggaacggtttaaaacggtttaaaaccccggg

SEQ ID NO: 172832 - DNA, 748 bp, Homo sapiens
  misc_feature: GYAE6OF02JT1QR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctagggttccagcctccgaggggtgtaaagttgtgccttagacctcacggtcttaccgaagtcctttcgagttccttgtagacctaccgaaagggaacgtaaacgtccaactacgtccaacccgttcgaccgggccagtccgaagcggtcggttaggaggttactctaacgtaccgttcggtaccacggacgtaacgacgaccgtaaggtacctacgtaccgttaccaaacggtccttccgtacacgtacgtaatacgttcgtacccttaccgtacttcctttcgaccggtaaccgggtccctacggttaccggttagtcgggttacgacgtaggtacggtactttacgggacgggacctttacggtaacctttccctaaccccggtttacaaacccttagtaacggtaactacggtacccggtaacggtacggtaccgtagtaacggtacgtacgacgtacgtacgtaacttacgttacgttactacgtactacgtacgtacgttaccttaacttacgtaccgtagtactacgtaccgtccgtacgtacgacgaccacgacgtacgtaagtaaccttacgaacgtcggtactacgacgtacaccgtactacggtccttagtacg

SEQ ID NO: 172833 - DNA, 583 bp, Homo sapiens
  misc_feature: GYAE6OF02JKDW9.27.78.H01.1.454.CMB.1.raw
  modified_base (128)..(128): a, c, t, g, unknown or other
  misc_feature (128)..(128): n is a, c, g, or t
  modified_base (141)..(141): a, c, t, g, unknown or other
  misc_feature (141)..(141): n is a, c, g, or t
  modified_base (148)..(148): a, c, t, g, unknown or other
  misc_feature (148)..(148): n is a, c, g, or t
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (550)..(550): a, c, t, g, unknown or other
  misc_feature (550)..(550): n is a, c, g, or t
tcagagcgtcgtctcacgaccggtgctcgatttagtgtgagtagtttgggtttggggatgagcaaaactgacaagtcaaggcaggagatgttgccatcacaactcattggttctgctgctctggtccngcctccaggggtnaaattgngctgactcagtctccagactttcagtctgtgactcaaagganaagtcacatccactcgccgggaccagtcagngtcggttggtatacgcttaacactggaccagcagtacgccaagtccaagtctaccgaaagcctcctcatacaaagtntcgcttccagtccttcgtcgtacgggtccctggacgtcagtgcaggtcgatcgcggacactacgttaccaccgtnaaccatacgaancgtccaggtanactagtaacgatcgacgtcgaacgtaacttagttacgtgttcacgtntaagtactaaccttacgttactagtagtacgactaccgaccgttcgtaaccgaacggaccgtaacgacgtacggtaacgtaacgtaaacgtacgttaccgtcgaacnccggtaactacctacgtcttcccgttataaccg

SEQ ID NO: 172834 - DNA, 784 bp, Homo sapiens
  misc_feature: GYAE6OF02GHFF3.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaaattgtgctgactcagtctccagtactttcagtctgtgactcaaaggagaaagtcaccatcaccgtgccggccagtcagacgtcgttggtagtagtcttacacgtggtaccagcagaacgccaggtcagtctaccaaagccttcctacactaccaaagttactcgtacccttcccgtaacgttccctttccgtccggtaccgggggttccccccttacgggtaccggggtttccgtaagggttcgggtacgtacggggtagggtacgtaccggttaggggaaccctaacgtttacctttacccaacccccgttaccaaacccgttactaccaaacgttaccgtaccggttaaggaaccgtcgttaacggaaacggtagtacggtaccgttaacgtaacccttaaacgttttaaccttacgtttaccggttacctacgttacggaacggttaacggtttaaccctttaacctttaacccgttacgtaacggttacttaaccgttacccgttaaccggttacccggtaaccggtaaccgggtaccgtaacggtaccgtaggggtaacgttaaacgttaaaccggacgttaggtacggtacgttaccgacccgtacttacgttccgttgtttaccc

SEQ ID NO: 172835 - DNA, 786 bp, Homo sapiens
  misc_feature: GYAE6OF02HTPGK.27.78.H01.1.454.CMB.1.raw
  modified_base (675)..(675): a, c, t, g, unknown or other
  misc_feature (675)..(675): n is a, c, g, or t
  modified_base (759)..(759): a, c, t, g, unknown or other
  misc_feature (759)..(759): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctcgtgggttccagcctccgaggggtagaaattgtgctgactcagtcctccagtactttcagtctgtcgaacctaccgaaaggacgaaacgtcaacctaacgtacctaccgtcggcccgggtaccaacggtccgaaggtacggtcggtttaggttaacgtacgtaccgttacgacgttcgggtaccaggacgaacggaacggccgtaacggtcgtaacggtccttaaccgaaacggtccttacccgtacgtaactacgtaaacgttacgttccgtaccctttcccgtaccgttcccgttaccgttacccgggtaacccggggttccccttacgggtacggttaccgtacgggtcggtacgtacgggttggtacgttacgggtacgggtaacctaacttaccgtttacccgtacccctaccgaaccttacgtaccgtaacgttaccggaccgttagaacccggttgtaagtaacgtcgtagtaccgtactaaccgttattacttacgtctaacgtactacgtaattaccgttactttacttaacgacgttanccgtacttaccgtaacccgttcggaacgtaacggcacggttacggtaggaacgttaaacgtaccgtaagtcggtctacgtaccnccgttaacgttctacgtctttaacccg

SEQ ID NO: 172836 - DNA, 833 bp, Homo sapiens
  misc_feature: GYAE6OF02GBDAR.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcagggtgaaattgtgctgaactcgagtctccagactttcagttctgtgacctaccgaaaggagtaaaacgtccaaccagtcaaccgtggcccgggtccagtcgacgtaggtaccggtttggtaacggtaggtacctttaacgacgtacggtaacccgagaccgaaggaacgtccgtaacggttaccgaagttcccgtaacccgtaaacgaccgttaccgtaaccgtaacttaaccgaaacggtttaacgttaccgtaacccgtttccccgtaacggtttaccccgtttaccgttaccggttaaccgggggttaccccctttaacgggttccgggtttaaccgacgggttacgggtaccgtaggtacggtaacgttacggtaacgggtaactacccggttaattacccgtaccgttaaccgacccgtaagtaccgtaaacgtacgtaccggttaacggtaactaccggtagtaaccgtagtaccgtcgaacgttaacggtaaaccttagtaccgttacgtacgtactaacgtaaccgttaattaacccgttacgtttaaccgtacgtaactacggttactacccgttacgttaaccgaacccgtaaagaccgtaacgtacggtaacgtaacggtaacgttaaacgtacgttagtaccggtgaaccggttcaaccgttatacggttcctaggttaccc

SEQ ID NO: 172837 - DNA, 746 bp, Homo sapiens
  misc_feature: GYAE6OF02H131I.27.78.H01.1.454.CMB.1.raw
  modified_base (162)..(162): a, c, t, g, unknown or other
  misc_feature (162)..(162): n is a, c, g, or t
  modified_base (175)..(175): a, c, t, g, unknown or other
  misc_feature (175)..(175): n is a, c, g, or t
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
tcagagcgtcgtctcacgaccggtgctcgatttagtgtgagtagtttgggttggggatgagacaaaactgacaagtcaaggcaggaagatgtgccatcgacaactcagtttggttctgctgctcgtgggttaccacgtccgtaccgaggggtataaagttgngctgactcagtcnccagtactttcagtctgtcgactaccgaaaggtacgaaactccaaccatccgaccgtcggaccggcctagtacgaacggagtcggttacggtagtagtcctanaccgttgaccagacagaacgcctaggtcacgtccaacgaacgtcctaccgatagtactaagttacncggttaccttcccacgtttccgtacgtaaccggggccccggttccctagggttacgtccgtacgggtccgtagtcgggtcgtgtaccgtaacgggtccttaactaccgtttaccccacccgttanaaacctacgtacgtaaacgtacccgngaacggtacgacgtacggtaagacggttacgtacgacgttaactacgtttaattaccggttacttaccgacgtaacgtaagttaaaccttaccgtttaacgttaccgttaagtacgttaccgtactacccggtacgttaccggaaacgaacggtaaccgacgttacggtaaggaaccgttaaacgtaaccgggtacgttaacgtaccggtccttacggaaccgtacctagttccgttccttacgttaaccc

SEQ ID NO: 172838 - DNA, 820 bp, Homo sapiens
  misc_feature: GYAE6OF02F1MNW.27.78.H01.1.454.CMB.1.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtcgacctaccgaaaggagaaacgtcaccatccacctggcccggcagtcagngcgttggtagtagtcttacncgtggtaccagcagaagccagtcagtcaccaagcctcctctactacaagtatcgtccttaccctcgttcccttctccggtaccggggtcccccttacggtacggtttccgaacggttcggcgtaggtcggtacgtccggttacgggaccttactacctttacccaaccccgtacctaccctaacttaacctaaacgttaccggaacccggttagggaaaccgttagtaacgggtaaacgtagttaccggtaccttaacggtaaccctttaaacgttttaactttaaccgttacgttaacctaacgttaacgtaaaccggtttaaccgtttaaccctttttaaaccgtttaacccgtaacggtttaagttaaccggttaaccttaacccggttaccccgtttaaccggggaaaccggttaaaacccgggaacgtttaaccggtaccggtaaacgggtaaacggtttaaaacccggttaaaaccggttacggttaccgggttaacgggtccttaacccggtaaccctacccgttaactttccgtttaccggtttaccctttaacccg

SEQ ID NO: 172839 - DNA, 712 bp, Homo sapiens
  misc_feature: GYAE6OF02HK52V.27.78.H01.1.454.CMB.1.raw
  modified_base (153)..(153): a, c, t, g, unknown or other
  misc_feature (153)..(153): n is a, c, g, or t
  modified_base (272)..(272): a, c, t, g, unknown or other
  misc_feature (272)..(272): n is a, c, g, or t
tcagagcgtcgtctcacgaccggtgctcgatttagtgtgagtagtttggggtttgggggatgagcaaaactgacaagtcaaggcaggaagatgttgccatcacaactcatttgggtttctgctgctcgtgggttccagccgtccgaggggtanaagttgtgcttgactcagtctaccagtactttcagttctgtaggaacacgaaaaggataaacgtcacatccaccgtcgccgggcagtcgagaggtcggttaggtagtacgtacttaacncgtacggtaaccaggacgaagaacgccgacggtacacgttaccaacgtaactcttccactatacgaaagttctccgtccgtttaccctaagttccgtttaccgaccgggtacccgggtcccgttacgggtaacggttcaaggttcggacgtcggtacggtacgtacggtacggaacctaacttaccgtttacccaacccttaccgtaaactaataacccgtaaagtccggaacgttaggaaacgtcggtaaagtaagaacgttcggaacttacgtaacctttaaacttttacggtactagtaacgtactacgaaagttacttaaccgtttaactacgacgtaatcgaaccgttctaccgtacggaaacgtaacgactacgtagtagtaattaacgtaacgtacgtgtacgtatacgactacctgtacttaccgtctaacg

SEQ ID NO: 172840 - DNA, 873 bp, Homo sapiens
  misc_feature: GYAE6OF02HSO0Z.27.78.H01.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttctgctgctcgtgggttccagcctccgagggtgtaaattgtgctgactcagtctcagtactttnagtctgtnactacgaaaggagaacgtcaccatccaccgtcggaccgggccagtcgaaggtacgtcggttaggtacggtacggtaccttaaccgtacgttacggtaaccctacggacgaaacggtaacggtacccgtagggtaccgtacgttaccgtaacccgtaaacggtccctacctactaactaacgtaacgttaacggtcgtacccgttacccctaaccgttcccgtttaccgttccgggtaccggggttcccccgttcggtaaccggttcgtacggtacggccgtaacgggtcggtacgttacggtacgggtaacctacgtaccttaccctacccgtacaaccgtactaacgaacgttaccgtaaccgtaggtaacgtacggtaagtaacgtacgttacgtaccgttaacgtaaccgttttaaactttaaccgttacgttacgtactaacggttacgtaaacggttaaccgtttaaaccctttaccggtttaaacctacccggtttaaaccgttaacgttacccgttaaccgtttaaccccgggtaccggttaaacccgaaaggtaaccccggtaacgttaacccgggttagggtaaaacgttaaaccggttaaaccgaacgttttaccggccggtttaacccgaccggtagttaaccccgttaacgttacccggtttctttaccccgg

SEQ ID NO: 172841 - DNA, 713 bp, Homo sapiens
  misc_feature: GYAE6OF02FN358.27.78.H01.1.454.CMB.1.raw
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
tcagagcgtcgtctcacgaccggtgctcgatttagtgtgagtagtttgggtttgggggggcatgagcaaaactgacaagtcaaggcaggaagatgttgccatcacaactcattgggtttctgctgctctgggttccagcctccaggggtnaaattgngctgactcagtcctccagtacctttcagtctgtgacctaccgaaagganaagtcaccatccacccgtgccgggcagtcaggcgtggttggtagtagtccttanacgtacgggtaccacgcaagaacgaccgaggtcacgtcctaccgaaacgcctcctcacacgtaatactcgtcctccctacgttccttcgtaccggtccggggttcccccgtcggtacggttccgtaggttcgggcgtagggtacggtacgttaccggtacgggtaacctaacgttcgtttaacccaccccttaccgtaacctacctacgtaaccgtgtaccggtaggtaacgtacgaggtaaacgtgcgtactacgtactaaactttacgttacctataccgtattacgacgtttaccgttacctttaacctttaccgtacgtaacgtacttacttcccgaacccggttacggaaacccgtaacgggtaccgaaccggtcggaagggttaacgtacgttaaaccggtaggtttcgtcgggacctctaccggacctacttccgtacgttacccg

SEQ ID NO: 172842 - DNA, 730 bp, Homo sapiens
  misc_feature: GYAE6OF02FVIJC.27.78.H01.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattggtgctgactcagtctccagtactttcagtctgtcgactaccaaaggagaaagtcaccatccactcggccggcngtcagngcgttggtagtacgcttacgactggtaccagacagaacgccgaggtcacgtacctaccgaaagtcctacctactactacgtaagtatcgtccttccctacgttccttctccggtaccggggtccccttacggtacggttcgacggtggccgtaggtggtactcggtacggacctactacttcctaaccccgtacaccctactactaaacgtaccggtacctacgggagtaccgttaacgaaacggtagttcgtacgtacgttaaccgtaaaccgtttactttaaccggttacggtaccttaacgttacgtaacgttaacgttaaaccctttaccgttttaaccctaacggtacgtttacgtaaccgtttacccgtaaacccgtttcccggggaaacgtaaacgggccgaaacggttacgtaacgggtaattaaacggttaaacgttacgtacggttcgacgtcgaacctacgttaaccgtcttacccgttacttaccg

SEQ ID NO: 172843 - DNA, 784 bp, Homo sapiens
  misc_feature: GYAE6OF02IPC24.27.78.H01.1.454.CMB.1.raw
  modified_base (226)..(226): a, c, t, g, unknown or other
  misc_feature (226)..(226): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcaacaactcattgggtttctgctgctcgtgggttccagccctccgaggggtagtaaattgtgcgtgactctacgtctccagtacttcagtctgtnactacgaaaggagaacgtcaccactaccaccgtcggaccgggccagtacgaggaggtacggttagggttagtaacgtacttaacgacgtacggtaccgagtacgaacggacgccgtaggtaccacgtaccacctaacgtcctacctactaactacgtaagttactacgtccttacctaccgttccttaccgtccgggtaccgggttcccgtacggtacggtcgtacggtacggtacgtaggtcggtacgttcggtacggtactaccgttacctttacccacccgtaaccctaccgtaataccgtaacgtaccgtacggttacggaacggtacgttaacgaaggtactcggacttaacgtaaccttaaccgttttacgttaccgtacgttaacctaacgttaccgtaaactttaaccgtttaacctttaaccgttacgttaaccgttacgtaacgttaacccgttaccgtaaacccggtttaaccggaaccggttaaaccggaaccggttaaacgttaacccgggtaaacggttaacggttaaaccggttaaacccggg

SEQ ID NO: 172844 - DNA, 639 bp, Homo sapiens
  misc_feature: GYAE6OF02GJ3BJ.27.78.H01.1.454.CMB.1.raw
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
tcagagcgtcgtctcacgaccggtgctcgatttagtgtgagtagtttgggtttggggggcatgagcaaaactgacaagtcaaggcaggaagatgttgccatcacgaactcattgggtttctgctgctctgggttccagcctccaggggtgaaattgtgctgacgtcagtctccagactttcagtcngtgactcaaaggngaagtcaccatcacgtgccggccagtcagagcgttggagtagccttanactggtacagcanaagcaggtcagtctacaaagctccgtcagtcaagtatgcttcccagtcctctcgagggtcccctggtacggttcacggtggactagtcggtatcggtacggggtaactaacgtacttttaccgacccttaccgacctaacgtctaaacgtacgtaccgttacggaacgtaccgtagtaaacgtagtacgtcgttacgacctaaacgtttacgttaaccgttaggttacctaactcaacgttaacgtaactttacccgtttaacctagtaaacgttcggtaacttcccgtaaccttccgggtaccaaagggttcccaggtacgtacggaacgtaataaaccggtactggtacgcgtacgaccacggtacttgtacttccg

SEQ ID NO: 172845 - DNA, 580 bp, Homo sapiens
  misc_feature: GYAE6OF02GTSLQ.27.78.H01.1.454.CMB.1.raw
  modified_base (306)..(306): a, c, t, g, unknown or other
  misc_feature (306)..(306): n is a, c, g, or t
  modified_base (565)..(565): a, c, t, g, unknown or other
  misc_feature (565)..(565): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggcagtccagagcgttggtagtagcttacactggtaccagccagaagccaggtcagtctccaaagctcctcatcaagtactgccttcccngtccttctcgacgggtccccctcggtaggttcagtggcaggtggatcgtgggacacgtacttttccaccccttcaccctatacctaatacgtccgtaggaacgtcgtagaagatgctgactaacttattacctgtctaatcgaagtacgttaccttacctttacctacgtaagtgtactaccgtaccgttacgggacccgaagggaccgtaccgacgtacggagtaacgtaaacgaacgtcggtacgcgtcgactaccncttacttcgtcttac

SEQ ID NO: 172846 - DNA, 767 bp, Homo sapiens
  misc_feature: GYAE6OF02HLKKB.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgacctaccgaaagggagaaagtccaccatccgacctcggccgggccagtccgagaggtcgttaggtagtacgcttaacgacgttacggtaccgagacgaacggacgaccgtacggtactaccggtacctaaccgtaaccgtacctcctacctacttacgtaacgttacgtccgtcccgttcccgttacgtttacccgtttaccggtaccgggtacccgggttaccccggttacggttacgggttacggtacggtcggtacgtacggtacggtacgtacggtacgggtaccttaccgttacccttaccctaccctaccctaacctacgtacgtaacgtaccgtaccggtacggacgtacgtaaggtaacgtagtaccgtacgtacggttaaccttaactttacgttaccgttacgttacgtactacgtaacgttaaccttaacctttaaccgttccgtaacgttacgtacgtaccgtaccgttaccgtacggaccgtaacggaccgacgtacggtaacgtaacgtaaccgtacgtacggtacggtcgtacgtacgtacgtactacgttcttccgttacttccg

SEQ ID NO: 172847 - DNA, 896 bp, Homo sapiens
  misc_feature: GYAE6OF02H8OTY.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctcgtgggttccacgcctccgaggggtgaaattgtgctgactcagtcctccagtactttcagtctgtacgactaccgaaaggacgaaacgtcaaccaacgtcaccgtcggccgggacacgtacgaggaggtacggttaggtacgtacgtaccttaacaccgtacggtaccagaacgaacggaacgaccgtacggtactacgtaccgtaaccgaaacgtccgttacccctacgacttaccgtaaaacggttcgttacccggttacccttaaccccgtccgttttacccccgtttacggtaccccgggtttaacccgggggttacccccgtacgggttaaccgggttttacgaaccgggttcggtacccgtaaggggttccggttaacggtttaccggtacgggtaaaccctaaccgtttaaccggttttaccccacccccgttaacgtaaacccgtaacgttaaacctaacggtaacccggttccgttaagggaacgttaaccggtaagggtaacgtaacgttccgggtataaccggttaaccttaaagtttaacttaccggtttaaccttataaccttaaggtaacgtaaccgtttaaccttaacccggttttactaaacggtacttaccgtaccgttacccgttaaccggtaccggtaaacggaaaccggtacgtaacggtaccgtaaaggtaacgtaaaccggttaaacggtcggttaaccggtacgtaccgtaccaaccgtaccgtacctttcgttaccgtcctttaacccg

SEQ ID NO: 172848 - DNA, 861 bp, Homo sapiens
  misc_feature: GYAE6OF02F6K1C.27.78.H01.1.454.CMB.1.raw
  modified_base (178)..(178): a, c, t, g, unknown or other
  misc_feature (178)..(178): n is a, c, g, or t
  modified_base (194)..(194): a, c, t, g, unknown or other
  misc_feature (194)..(194): n is a, c, g, or t
  modified_base (238)..(238): a, c, t, g, unknown or other
  misc_feature (238)..(238): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaattcattgggtttctgctgctcgtggttccagcctcgagggtnaaattgtgctgactcngtctaccagtacctttcagttctgtcgaacctaccgaaaagganaaacgtccaaccgtatccgaccgtcggacccgggacctagtcgagacggtacggtttggtaagtacgtaccttacgtaccgtacggtaccagtcgaacgtacggaccgtaggtaccgtacgtaccgtaccgaaacgtcctaccctacgtaacttaccgtaaacgtactacgtacccttacccgtaacgttcccttaccggttaccggtaccccggggtttacccttacgggtaccggtttaccggaacgggttcggtaccgtaacggttacggttacgttaccggtaccggggttaaccgtaaccgttttaccgtttaccccgtaaccccgttaccgttaaacccgttaaaccgttaaccggttaaaacgttaacccgggtacccggttaaagggtaaacccgttacgtttaaacgggaaacgttacgttacccggtacgttaacgtaaccgtaaacgttttaccgttaacgtacgttacgtaacgttactaaaccggttaaacttaccgttaaccgtttacccgaagttaaccgtacgttacccgtaccgttaacccggtaccgtaaccgtaaccggtaccgtaacgtaccggttaacgggtaaccgtaacgtttaaaccgg

SEQ ID NO: 172849 - DNA, 872 bp, Homo sapiens
  misc_feature: GYAE6OF02FYVE4.27.78.H01.1.454.CMB.1.raw
  modified_base (202)..(202): a, c, t, g, unknown or other
  misc_feature (202)..(202): n is a, c, g, or t
tcagagcgtcgtctcacgaccggtgctcgatttagtgtgagtagtttgggtttggggagtgagcaaaactgacaagtcaaggcaggaagatgttgccatcacaactcattcgggtttctgctgctctgggttccagcctccgaggggtgaaattgtgctgactcagtctccagactttcgagttctgtgaactacaaagganaaagtcaaccataccaccgtcggccggtaccagtccgaagtaggaccggttagggtaacgttacggactttaacaacgtttcgggaaaccctaagacgaacggaacggtaccgtaacgggttacgaacggttcccttaaacccgaaaaggtcccgtttacccctaactaacgttaacccgtaaaggtttaactacgtacccgtttaaccccgtaacgttcccgtttaaccgttcccggtaaccggggttccccgtacgggttaacccggtttcgaaaccggttcgggccggttaaacgttcgggtacgttaccggtaacggtaacgtaccttaaacttttcccgaaccctactaaacccgttacaacgttaaacggtccgttaaccggtacggaacgtacggtaacgaaacggttacgtaacgtgtacggtaacttaacggtttacttaccggttaacgtacgttaacttaacgttaacgtaacggtttaacccgtttactttaaaccctagttaaccgtaacgtaccttaccgtaaccgttttaccgggaaaccggttacggaacggtaacccggtaacgtacgggttaaaggttaacggtaaacggtaacgtttaccggaacgttacggacgtacctaaccgtcgttaccggttacttccgttaaccg

SEQ ID NO: 172850 - DNA, 807 bp, Homo sapiens
  misc_feature: GYAE6OF02ILR2H.27.78.H01.1.454.CMB.1.raw
  modified_base (147)..(147): a, c, t, g, unknown or other
  misc_feature (147)..(147): n is a, c, g, or t
  modified_base (192)..(192): a, c, t, g, unknown or other
  misc_feature (192)..(192): n is a, c, g, or t
tcagagcgtcgtctcacgaccggtgctcgatttagtgtgagtagtttgggtttggggatgagcaaaactgacaagtcaaggcaggaagatgttgccatcacaactcattggttctgctgctctgggttccagctcagggtgaattgngctgactcagtctccagtactttcagtctgtgactacgaaagganaaagtcacatcactgccgggcagtcagagtcggttcggtagtagcttacgactggtaaccagtaccagaaacgcccgagggttaccagtaccgtaccgaaaaaggtccttacccgtacctaaagttacccgtaaaagggttaatttaccgggtacccttttaccccccgaggttttacccctttaccgttaaccgggtaccgggggttacccccccttaggtaaccggggtttaccctaagggttcgggtaccgtaaggtcggggtactttcggtacgggtaacctacgttacgtttaccctaaccccgttacctaacctaacgttacaaacgtaccggtaccctgggaaactccgtagtaaacgggtaacttcgggaccttaacggaaccgttaaaccggtttaactttaaccgtacggtttacctaacgttacctaaacgggtacttaacccgtttaaactttaccccgttaaacgttacgtacgttaactacccgtaccttacgggaaccgtaaccggtaccgaagtacccgtaggtaacgtaaacgttaaacgaacggttacggtacgaccgtagtaacccgtacttaaccggtcttccgttacttaccgg

SEQ ID NO: 172851 - DNA, 734 bp, Homo sapiens
  misc_feature: GYAE6OF02HIZIO.27.78.H01.1.454.CMB.1.raw
  modified_base (359)..(359): a, c, t, g, unknown or other
  misc_feature (359)..(359): n is a, c, g, or t
  modified_base (621)..(621): a, c, t, g, unknown or other
  misc_feature (621)..(621): n is a, c, g, or t
  modified_base (713)..(713): a, c, t, g, unknown or other
  misc_feature (713)..(713): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctggttccagcctccaggggtgaaattgtgctgactcagtctccagtactttcagtctgtacgactaccgaaaggagaaacgtccaccatccaccgtcgccgggaccagtcagacgtcggttaggtagtacgtcttaaccgacgtacggtaaccgaggtcaaggaacgaccgtaagggtcaggtacctaacgaaacgtcctaccgtacatacgaagttatccggtaccttacccgngttaccctttcgtaccggtaccgggttccccctacggtaacggttcctagggtcggcgtacggtggtactccggtacgggactacttaacttaccacccgtacctaacccacttacaaacgtcgtaccgtaaggacgtcgtaagacgtaagtacgtactacgtaacgtaactttaacttaccttacgtcaaacgttacaacggttaaccttaaccgttaacttttaccgaacgtaacgtacgtaaccgtacctttaacccgnggttaaaccgaaccggaacgtaccgtagaacggtaacgttaaacgtaaaccgtaacgtacgggttaccgtagtaccgttaccaccgtttacnccgttggttccctttaacccg

SEQ ID NO: 172852 - DNA, 804 bp, Homo sapiens
  misc_feature: GYAE6OF02GX2M1.27.78.H01.1.454.CMB.1.raw
  modified_base (241)..(241): a, c, t, g, unknown or other
  misc_feature (241)..(241): n is a, c, g, or t
  modified_base (730)..(730): a, c, t, g, unknown or other
  misc_feature (730)..(730): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctcgaggggtgaattgtgctgactcagtcctccacgtactttcgagttctgtcgaacctaccgaaaaggganaaacgtccaaccactccaccgtcggccggaccagtcgaaggacggtcggtttaggtaaggttacgtaccgttaactacgtacggtaaccacgtacgaagtaacggcccgtaggtccgacgttcctaaccgaaaccggtcccttaccctcaacgttaaccgtaaagttacgttacccgtcccctttaccccgtacgtttaccccgttttccgtaccgggttaccccgggggttcccccgttacgggttacgggtttccgaacggggtcgtccgggtaggttacgggtaccgtttaccgggttacggggtaaccctacgttaccgttttcccaacccccgttacccaccctaactactaaacggttaccgaccgtaacgggaacgttcgtaggaacgtcgtacgtcctaaggttaaccttaaacggtttactttaccgtataacgtactacgtaacggtaactttaaccttacctttacgccgttaacgtntaccttacccgttccggttaacggaaccgtaacggtacctacgtaccggtaagggtacttaaccgttaaacggg

SEQ ID NO: 172853 - DNA, 867 bp, Homo sapiens
  misc_feature: GYAE6OF02IQWAP.27.78.H01.1.454.CMB.1.raw
  modified_base (119)..(119): a, c, t, g, unknown or other
  misc_feature (119)..(119): n is a, c, g, or t
tcagagcgtcgtctcacgaccggtgctcgatttagtgtgagtagtttgggtttggggatgagcaaaactgacaagtcaaggcaggaagatgttagccatcaacaactcattgggtttcngctgctcgtgggttccagcctccgagggtagaaattgtgctgacctcagtcctaccagtacctttcagttctgtacgactaccgaaaaggacgtaaacgtccaccatccaccgtcggccggacctagtcgagcgtcggtttggtagtacgtacttacacgttacggaccacggtagagaacgtccgacggtactacggtacctaacgtaaacgtccttcccctaatacgttaaactaaggtttaccgttcgtcccctttacccgtacgtttacccgtttaaccgtcccgggtacccggggtttacccccttacgggtagggtttaccgtaacggtccgggttacgtacgggttaacggttcgtacggtaccgggtaacccttaacgttacctttaacccaacccgtttcaacccgttataaccgtagtttacccgacggtaacgacgtacgtagtacggtacgttacgtaccgtacgttactaaccgtttaacgttaccgttaacgttcttaaccggttaaccgtacgtttaacccggttaaccgttttaaccctttacccgtaaacgttaccgttagttaacccgttaccgttaaccccgggttaaccggtaacccggtaaaccgtaccggtaccggtaggttaaccggtaaccgttaaacggttaaaccgggttacgttaaccggtaccgttacggtaacccggtaccgtaccgtacgttacccgttaccggttccttaaccccgg

SEQ ID NO: 172854 - DNA, 703 bp, Homo sapiens
  misc_feature: GYAE6OF02FZJTF.27.78.H01.1.454.CMB.1.raw
  modified_base (235)..(235): a, c, t, g, unknown or other
  misc_feature (235)..(235): n is a, c, g, or t
  modified_base (289)..(289): a, c, t, g, unknown or other
  misc_feature (289)..(289): n is a, c, g, or t
tcagagcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctcgtgggttccagcctccgaggggtgaaattgtgctgactcacgtctccagtactttcagttctgtgactaccaaagganaaacgtcaccatccacctcgccggccagtcgagcgtcgtaggtagtagcttacncgtcggtaccagacacgaagcgtagtctacgttccaacaagcctctactatactaagtatcgtcctacctacgttcccttcgtaccggtaccgggttcccgtacggtacggttcgaacgttcgggactaggtagggtcttacggtacgggtacctaacgttcctttaaccccacccgttaccctaacgtaacttaaccaaacgttaccgtacggttacgggaaacgttacgtaacggtaaatacggttagtccgtaacttaccgttaaactttacgtcctttaggtaccttacgttaacgaacgtttaacgttaacctttacctttaccgtacgttaagtacttacgtacccttacccggttaccggtaaccggaacgtacaacccggtagtaacggtaacgtaacttaaccgg

SEQ ID NO: 172855 - DNA, 835 bp, Homo sapiens
  misc_feature: GYAE6OF02I0XOM.27.78.H01.1.454.CMB.1.raw
  modified_base (379)..(379): a, c, t, g, unknown or other
  misc_feature (379)..(379): n is a, c, g, or t
tcagagcgtcgtctcacgaccggtgctcgatttagtgtgagtagtttgggtttggggatcttaaaagaggttctttctcgtgggatgtggcatgagacaaaactgacaagtcaaggcaggaagatgttgccatcacaactcattgggtttctgctgctctgggttccagcctcgagggtagaattgtgctgactcagtctaccagtactttcagtctgtcactacgaaaggagtaaacgtcaaccatccaccgtcggaccgggacctacgtccgaggacgtcggttacggtaagttacgtaccgttaaccgtacgtacggtaacccaggacaacggtaacgaccgacggtacctacgttccaaccgaagtcctccctanactacaaggtactcgccttaccgtacttccgttcgtaccgtcggttcccgtacggtcgttacgtgttcggccgtaaggtcggtaacgtcggtacggtaccgtaccgttactttaccccggtacccctacgtaaccctaacgttcccgaaacgttaccggaacccggttacgggaaaccgttaaccggtacggaaaaccggttgtaaccggttaccgtaaccgttaaccgttaaaccgttttaacgttaacccgtttacgttaacccgttaacggttaaaccttaaacgggtaaccgttttaaacccttacccctttttaacgaaccggttttaaactccggtttaaacccgttccgttaaaccccggtttaccccgggaaaacctaaccggggttaacccgtaacccgggttaacgggtaacggttaaaacccggtaacggttttaaaaaccccgg

SEQ ID NO: 172856 - DNA, 735 bp, Homo sapiens
  misc_feature: GYAE6OF02H1LDC.27.78.H01.1.454.CMB.1.raw
  modified_base (156)..(156): a, c, t, g, unknown or other
  misc_feature (156)..(156): n is a, c, g, or t
tcagagcgtcgtctcacgaccggtgctcgatttagtgtgagtagtttgggtttggggggcagtgagcaaaactgacaagtcaaggcacggaagatgttgccatcacaactcattgggtttctgctgctcgtgggtccagcctcgagggtgaattgngctgactcagtctccagtactttcagtctgcgactccgaaaggagaaacgtcaccatcaaccgtggccgggtccagtcagtacgtcggttaggtaagtacgtctttaacgacgttaggtaacctagcaagaacgccaggtcagtcctaccgaaacgtctcctacatactaaggtactcgtcccttacccgagtcccgtttactccggtaccggggtaccccttaggtacggttcgacggtcggacgtacggtaggtacgttacggtcgggtaacctacgtactttacccgaacccttacgaacctaacgtactaacgttacggaccttagggaactacgtaacggaagtacgtacggacgttacgtaaccgttaaactttattaaccgttgtactaacgttactaagaaaccgtttaccttaacctttaaccgacgttaagtacgtacgttacccgtaacgttaccggaacgtaaccggtaactaccgtacgtagggtaaaccgttaacgttaaaccggtacgttagggtacgtacgtttacggaaccttaccctacgttacccggtactttaacccgg

SEQ ID NO: 172857 - DNA, 826 bp, Homo sapiens
  misc_feature: GYAE6OF02G3AKU.27.78.H01.1.454.CMB.1.raw
  modified_base (240)..(240): a, c, t, g, unknown or other
  misc_feature (240)..(240): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagccctccgagggtgaattgtgctgactcagtcctccgagtactttcgagtctgtcgtacctaccgaaaggganaaacgtccaccattccaccgtggccgggaccagtcagtagtcgtttagggtacgtagaccttacgacgtggtaccagaccaggaacgccgaggtccacgttccgtaccgaaacgtcctaccctacgaactacgtaaagttactaccgtacccttacccgacgttcccttaccgtaccggtacccgggggttaccccctacgggttaacggttacgtacggttcgggtacgtagggttacggacgttccggtacgggaaccctaaccgtttacttttacccctaacccccgttcaaccccgtaattaccgtaaacgtaccggtcccggtaagggtaaccgtaccgtaagggaaacggttagtaccggtaccttaaccggtaacccttaaaacgtttttaccgttaaccttacgggttaacccttaacgttaaacccggtaaacgttaacccgttttaacccgttttaaaccttttacccgtaacgttaacgttcggtaaccctttaacccggttacccggttaacccgggtaccgtaaacggtcccgtaaccggtaacggttaacgtaacgtaacggtttaaacccg

SEQ ID NO: 172858 - DNA, 753 bp, Homo sapiens
  misc_feature: GYAE6OF02F35KO.27.78.H01.1.454.CMB.1.raw
  modified_base (151)..(151): a, c, t, g, unknown or other
  misc_feature (151)..(151): n is a, c, g, or t
  modified_base (527)..(527): a, c, t, g, unknown or other
  misc_feature (527)..(527): n is a, c, g, or t
tcagagcgtcgtctcacgaccggtgctcgatttagtgtgagtagtttgggtttggggatgagcaaaactgacaagtcaagggcaggaaggatgttgccatcacaactcagttgggttctgctgctcgtgggttccagcctccgaggggtanaattgtgctgactcagtcctaccagtacctttcgagttctgtacgacctaccgaaaggagaaacgtccaccacgtccaccgtcggccccgggcagtaccgaggtacggtcggttgggtaagtacgtacctttaaccgacgtcggtaacccaggacgaacggaacggtcccaggtccacgtcctaaccaaacgtccttcccgactaacttacgaaacggtcttccggtaccccttaccccgtacgtttccccttacggtacccgggtacccggggttcccccttagggtaacggtttccgagggtcgggtacgtaacggtggtactacggtacgggaccttaactaccttttacccacccttacacactactaaacncgtaccgtaggaacgtcgtaagaagtctacggtactacgtacctttaactagttcgttacgtctacgttacgtacgttaaccttaccgtttaccttaaccgtacgttacgtacgttcctaccggttaaccgtaccggaaccgaacgggtaccacggtacgttaaggtaacgtaacttaacggacgtcggtactcgtacgacctacgttatcccgtttatactcccg

SEQ ID NO: 172859 - DNA, 787 bp, Homo sapiens
  misc_feature: GYAE6OF02HDDUB.27.78.H01.1.454.CMB.1.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (393)..(393): a, c, t, g, unknown or other
  misc_feature (393)..(393): n is a, c, g, or t
  modified_base (756)..(756): a, c, t, g, unknown or other
  misc_feature (756)..(756): n is a, c, g, or t
  modified_base (765)..(765): a, c, t, g, unknown or other
  misc_feature (765)..(765): n is a, c, g, or t
  modified_base (773)..(773): a, c, t, g, unknown or other
  misc_feature (773)..(773): n is a, c, g, or t
tcagagcgtcgtctcacgaccggtgctcgatttagtgtgagtagtttgggtttggggggcatgagcaaactgacaagtcaaggcaggaagatgttcgccatcacaactcagttggttctgctgctctgggttccagcctccgaggggtgaattgtacgctgactcgagtcctccgagtactttacgngttcctggtanaccttacgaaaggagaaacgtccactactccacgtcggacccggcagtacaggtaacggtccgtttagggtagtacgtactttaccgacggttacggtaaccaggtacgtaacggaacgtcccgtagggtctaacggttcctaaccgaaggtccctaccctactaggttacaaggttactacgtcctttacccgngtttaccccttcgtaccggtaccggggtaccccttacgggtaccggttaccgagggttaccgcgttacggttaacggccgttacgggacggtaactaaccggtttcttaccccgtaaccttaccgaaacctcgtaaccgtaagttcccgaacggttaggacgttacgagtaacggtgtaccggtactacgttaacccggttaatttacggttcgtaccgggttaacaccgtacgtaaaggtttacctttaccgtttaaaccgggttcctaagttaaaccggtcgtaacgttcccgttacggtaccgacggtaacgtacgccgtagtcggtaacttaacggttaccggaattcggaaccggttnaccccgttnacccgttnttaccgtgttaccg

SEQ ID NO: 172860 - DNA, 795 bp, Homo sapiens
  misc_feature: GYAE6OF02HQ8EM.27.78.H01.1.454.CMB.1.raw
  modified_base (150)..(150): a, c, t, g, unknown or other
  misc_feature (150)..(150): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctgggttccagcctcgagggtgaattgtgctgactcagtcnccagtactttcagtctgtgactaccgaaaggagaaacgtcaaccatccaccgtggccggacagtacagagtcggttaggtagtacgccttaacacgttacggtaccagacgaggaacgccgtaggtcacgtacctaccgaaagtcctcctacatacgaagtactcgtacccttccacgtttcccttacgccggtacccggggtcccctacggtacggtttcgacggtcggtacgtagggtacgacggtcggtacggggtaacctaaccgtttaaccgtttaccccctaacccctaaccgaacccgttaaagttaacccgaaacgtttaaccgggtacccggttaacgggaaaacgtttaccgaaggtaaacgcgttaccggtacgtaacgttaaacccgttaaaccttttaacgttaccgtttacgttaacgtaacctttaacggtaaacgttaaccgtttaaacctttaacccgtttacccttaagttaaaggttacctacccgttaaccgttaccccggttaaccggtaacccgggaaacggtaacccggtaacggttaacccggtaaggttaaacgttaaccgtttaaaaccggg

SEQ ID NO: 172861 - DNA, 664 bp, Homo sapiens
  misc_feature: GYAE6OF02GWW3U.27.78.H01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtgaaattgtgctgactcagtctccagtactttcagtctgtagacctcaaagganaaagtcaccatccaccgtcgccgggcagtcagagtcgttggtagtacgtcttacacgtcggtacagcgaagacgccgaggtcacgtctaccgaaacgcctccacgactacaagttatcgtaccttcccgtagttcccttacgtcggtaccgggttcccctaggtacggtttcgacggtcggacgtaggtacggtactacggtacggggaacctacttactttcccgaaccctaccgacctactacctaacgtacgtaccgttaggaacctagacgaaagtctacggtacctacgtaaccttaacctttagtttaccgttagtactagtaaccgtaacggttaaccttacctttaacttacccgtaagtaacgttcgaactacccgtaccgtacgtaacgacggtaccgaccgtagtacggagtaactaacgg

SEQ ID NO: 172862 - DNA, 660 bp, Homo sapiens
  misc_feature: GYAE6OF02GSNS1.27.78.H01.1.454.CMB.1.raw
  modified_base (293)..(293): a, c, t, g, unknown or other
  misc_feature (293)..(293): n is a, c, g, or t
  modified_base (327)..(328): a, c, t, g, unknown or other
  misc_feature (327)..(328): n is a, c, g, or t
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
tcagagcgtcgtctcacgaccggtgctcgatttagtgtgagtagtttgggtttgggggatgagcaaaactgacaagtcaaggcaggaagatgttgccatcacaactcattgggtttctgctgctctgggttccaggcctccgaggggtgaaattgtgctgactcagtctccagtactttcagtctgtgactaccgaaaggaagaaagtcaccatccaccgtacggccggggaccagtacgaggaggtcggttagggtagtacgtacttacacgtacggtaccagacgagaacnccgagtcagtcaccaagcctcctacatacaagtnntccttaccncgttaccgttcctacggaccgggtccccgtcgtacggtttcgngtacggacgtggtaggtcgtacggtaggtacctactactttacccgaccctacacctatactaacgtacgccgtagggactcgtaaggaacgcgtcgacttacgaacttaaccttacttacgtgttatacggtactaaggtactaaacctttaccgttaacctaagtacgtactccgttaccgttaccgttaccgaaaccggtaacgactaccggtatacggaagttaacgtaacgtaccgtagtcggtactacgcgtaacctacgtcttacgttctacg

SEQ ID NO: 172863 - DNA, 783 bp, Homo sapiens
  misc_feature: GYAE6OF02GHKDB.27.78.H01.1.454.CMB.1.raw
  modified_base (142)..(142): a, c, t, g, unknown or other
  misc_feature (142)..(142): n is a, c, g, or t
  modified_base (148)..(148): a, c, t, g, unknown or other
  misc_feature (148)..(148): n is a, c, g, or t
tcagagcgtcgtctcacgaccggtgctcgatttagtgtgagtagtttgggttgggggcatgagcaaactgacaagtcaaggcaggaagatgttgccatcacaactcattgggttctgctgctctggtccagtcctcagggtnaattgngctgactcagtctccagtactttcagtctgtcgactaccaaaggagaaagtcacgatcacctgccggcagtcagacgtgttgatacgcttacacgtgtaccagcgtagaacgccgaaggtcaacgttcctaccaaagtcctacctactacgtaccgtaagttacgtaccgtaccgttaccccgtacgtttcccgttaccgttaccgtaaccgggggttcccccgttacgggttacgggtttaccgtagggttacggtaccgtaaccgggttgggtaacgttacggtacggggtaacctaaccggttagtttaccccaacccgttacctaacccgtaattacccgtaaagttaccggaccgtttaacgggaacgtacggtaacgtaacgtaacgttcggtactacggtaccctaacgtttaacttaccgtatcgtaacgtacgtaacgtactttaaccgttaaccgtttaacgtacctaaacggttacgtaccttaccggtaacccggttaacgacccgaaagggttaaccgaccgtacggtaacggttaacggtaaacgtttaaacccggtacggttacggtaccgtaccggttacgtacccgttacccggtaatttccccgtaggtttaacccc

SEQ ID NO: 172864 - DNA, 701 bp, Homo sapiens
  misc_feature: GYAE6OF02FS8OG.27.78.H01.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
tcagagcgtcgtctcacgaccggtgctcgatttagtgtgagtagtttgggtttgggggggcatgagcaaaactgacaagtcaaggcaggaagatgtgccatcacaactcattgggtttctgctgctctgggttccagcctccgaggggtnaaattgtgctgactcagtctccagactttcagtctgtgactcaaagganaaagtcaccatcacctcgccgggacagtcagacgcgttaggagtagcttacacgtggtaccagctagaacgccgaggttcacgtctacctaaaacgctacccgtnaactacaacgtatcgtaccttcccacgttccttctacgacggggttcccctacggtaggttaccngtacggatacggtgactcgtgggacacgtactttccgaaccctacacctaactaccaactacggaccctagggtaacgacgtaagaacgtagtacgtccttaggaccttaaaccgtttaatttaagtcccggttaactaaccgttaactaaacggttaaccgtaaccgtttaaccttttaaccgtacgtaacgttagtaactacccgttaaccgttaaccggaaccggtaacgggactaccccggtaaggtaacggtaacgttaaagtttaaaaccggaacgtacggtttaggaccgttacgacccgtaacctagttaccgttccgtttaac

SEQ ID NO: 172865 - DNA, 722 bp, Homo sapiens
  misc_feature: GYAE6OF02F2MXY.27.78.H01.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (583)..(583): a, c, t, g, unknown or other
  misc_feature (583)..(583): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtagaaattggtgctgactcgagtcctccagtctttacngtctgtcgactaccgaaaggagaaagtccaaccntaccacgtcggcccggacacgtacgaggtaggtcggtttaggtacgtagtaccttacgacgtcggtaccagacaagtaacgaccgtaggtctacgtacctaccgaaagtccttcccgctaactcgtaacgttataccgtacccttcccgacgtttccttaccgtcccgggtaccgggttccccgtacgggttaaggttccgacggttacgggtaccttggtcggggtacttaccgggtacgaaaccttacctttaccgtaaccctacccgtaccactacgtaactacgtacgtaccgtaggactaggtaggtacgtgtacgtactacggtaacttacgttttaactcgtacgtacgacgttanaacgtttacttaaccctttacgttactacgtacgtaccgttactacccgttacgtacggaacgaacggtaccacgtaagtacggtagtaaactaacgtagttcgtcggtacgtagtacccgtactcgttcgtacgttcc

SEQ ID NO: 172866 - DNA, 773 bp, Homo sapiens
  misc_feature: GYAE6OF02IKQUW.27.78.H01.1.454.CMB.1.raw
tcagagcgtcgtctcacgaccggtgctcgatttagtgtgagtagtttgggtttggggggcatgagcaaaactgacaagtcaaggcaggaagatgttgccatcacaactcattgggtttctgctgctctggttccagtccctcgagggtgaaattgtgactgactcattcctccgtgtacctttcagttctggtacacctacgaaagtacgtaaacgtccacctaactcaccgtcggcccgggtcctagtacaggtcgtcggtttaggtacggtacgtacttaacgcgttacggtaccgacgacggtacgaaccggccgtacggctaacgtccttaacccgaaaacgtccctcccgttacagttaccgtaaattacggccgttacctttaccccgtacgtttcccgtttaccggtaccggtacccggggttcccgttacggttaccggttacggacgttccggacggttacgggtcggtacgttccggtaagggtacctactaaccggtttccacccttaacgaccttatacgtaacgtcgtacgtacgtacggaactacgacgtagtcgcgtagtaccttaacgtttacttacgttacgtataccgtacgttacgtacctttaaccgtttaccgttaaccgttagttaacgtcgttaaccgtacgttaaccgtacggaacccgtaggtaccgtacgtcggtacggtaaacggtaaacttaaccggttacgtacggttagaccgacgtaccgtacgtacgttcgtaccggttcc

SEQ ID NO: 172867 - DNA, 902 bp, Homo sapiens
  misc_feature: GYAE6OF02HANUQ.27.78.H01.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaagtcaccatccacctcgccggccagtcagngtcgttaggtagtacgcttacactacggtacagacgagaacgccgacggtcagtacctccaaacgcctacctctaatacgtaagtatcgccttaccccgtacgttccctttccgtaccgggtaccggggttccccccgttacgggttaccgggtttaccgtaagggttcggtacggtagggtttacggggacgtttaccgggttacgggggtaacccctaacttaccgttttaaccccgtacccccttaccctaaacccttaacttaaccctaaacgtttaacccggaccggttaacgggtaacggtacggttaacgggtaaacgttacggttacggtaccgttaacggttaaaccttaaacctttttaaacgtttaccgtttaacgtttaacctaacgttaaccgtaacgtttaaccggttttaaccttttaacccgttttaacccgtaacgttaaacggttacggttaacttacccgttaacccgtttaccccggggtaaacccggtaaacggggaacccgtaaccgggttaaccggttaacggggtaaacggtttaaaaccggtttaaaacccggttaacggttaaccggggttaccggtaccggttaacccggtaacctaaccccggttaaccggtttaccgtttcccggtttaccctttaaccccgg

SEQ ID NO: 172868 - DNA, 819 bp, Homo sapiens
  misc_feature: GYAE6OF02G7N18.27.78.H01.1.454.CMB.1.raw
  modified_base (664)..(664): a, c, t, g, unknown or other
  misc_feature (664)..(664): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttgggtttctgctgcgttcgtgggttaccagcccttccggaggggttagaatttggtgtctgactcacggtcctaccgtagtactttcgagttcgtcgtagacctaccgtaaagggaacgaacgttccaaccgtacgttaccgaccgttaccgggacccgggtaccaacggttccgaaggttacggttacggtttacgggttaacggttaaccggtacctttaaccgtacgtttaccggtaaccgtaggacgtaaccggaacggtaccggtagggtaccgtacgttacccgtaacccgtaaacggtcccgttacctacgtacttaaccggtaagttaaccgttcggttaccctttacccgtaacgtttcccgttaccgtaccgggtacccggggtaccccggtttacggttaacggttcggtacggttacggaccgtagggttccggtacgtttacgggacgtaccgtaactttcgttaccaccccgtacgaactacgtactaacgtcggtacctagggaacncgtaagtacgtacgtctacggacttaacgttaacgtttacgtgttacgttaacgctaacggttacgttaacttaccgttaccttttagaccgttaaggtcctacgttacccgacgtaccgcggaacgactaaccggatacggtaactagtaacgg

SEQ ID NO: 172869 - DNA, 699 bp, Homo sapiens
  misc_feature: GYAE6OF02FX3AF.27.78.H01.1.454.CMB.1.raw
tcagagcgtcgtctcacgaccggtgctcgatttagtgtgagtagtttgggtttggggatgagcaaaaactgacaagtcaaggcaggaagatgttgccatcacaactcattgggtttctgctgctctgggttccagcctccaggggtgaaattgtgctgactcagtctccagactttcagtctgtgactaccaaaggagaaagtcaccatccacctgccgggccagtcagagtcgttggtagtacgtcttacacgtaggtaccagcaagaagccaggtacagtctaccaaagctcctcactacaagtatgtccttcccgagttccttctacgaccggggtcccccttacgacggttacgaggtcggcgtacggtgggtacgtcggtacgggactacctacgtttcccaaccccgtcaacctactaacgtaacctcgtaccgtaggacgtacgtaacgagtaagtcgtacgtacgtaaccttaaacgttcttaacgttactactaacgtaacgttaacgtaacctttaaccttaaccgtttaaccgaacttaacggttacctaaccgttaccgttacccgttaccggaacccgggtaaacgtaccgaacgttacggtaaggtaaaccgtaaaccggttaacggtaaccggttcgtacggtactaccgtacctaccgtatttaccgttccgtacttaccccg

SEQ ID NO: 172870 - DNA, 748 bp, Homo sapiens
  misc_feature: GYAE6OF02HJL0R.27.78.H01.1.454.CMB.1.raw
  modified_base (233)..(233): a, c, t, g, unknown or other
  misc_feature (233)..(233): n is a, c, g, or t
tcagagcgtcgtctcacgaccggtgctcgatttagtgtgagtagtttgggtttggggatgagcaaaactgacaagtcaaggcaggaagatgttgccatcacaactcattggtttctgctgctctgggttccagccctccgaggggtagaaattgtgctgactcagtcctccgagtactttcagttctgtgactccaaaggagaagtcacatccaccgtggccggccagtcagngtcgttaggtagtacgcttacgacgtacggtaccagcaagacgaccgaggtactacgtcctaaccgaaacgtcctccctactaacgtaacgtaacgttacgtccgtaccccttccccgtacgtttccccgttacggtcccggttacccggggttccccgttacggtacggttaccggtagggtccggtacggtaaggtcggacgttcggtacggtacctaacgttcgtttaccccaaccccgtacctaaccctaactaaccgtaaacgtacggtaaccggtaggaaacgtcgtaaagtaagtactcgacgttaacgtaacctttaattacgttacttagtactaactaacgtaacggtactttaacccgtttaacgttaccgttacgtagtacgtaacccgttccgtaacccgttaccgggaccggtaacgtacgtacggtacgtaagtaaccggtaattaaccggaggttaaccgtcgtaccgtacgactaccgttgtaccttcgtccttaccg

SEQ ID NO: 172871 - DNA, 587 bp, Homo sapiens
  misc_feature: GYAE6OF02FPZNL.27.78.H01.1.454.CMB.1.raw
  modified_base (145)..(145): a, c, t, g, unknown or other
  misc_feature (145)..(145): n is a, c, g, or t
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
  modified_base (574)..(574): a, c, t, g, unknown or other
  misc_feature (574)..(574): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctcaggggtnaaattgtgctgactcagtctccagactttcagtctgtnactccaaaggnaaacgtcaccatcactgccgggcagtcagagtcgttaggtagtagcttacacgtggtaccagacagaagccgaggtacagtctacaaagctcctcatactaagtctgtccttccctagtccttcgtcgacgggtcccctggtacggttcagtggctagtgactcgnggacactagttccaccgtacaaccatacaacgtacgaccgtaggaaagtccgtagaaacgtntacggctagaccttaattacttacgttacgtacagttacaagtacgttacctacctttaacgacgtaagtgtaccttacctaccgtccggaacgtaacggactacgtacgtagtaacgtaaagttaacgacgtgacgtcacgacctaccgtntcgtacgtctacg

SEQ ID NO: 172872 - DNA, 868 bp, Homo sapiens
  misc_feature: GYAE6OF02IW5GD.27.78.H01.1.454.CMB.1.raw
tcagagcgtcgtctcacgaccggtgctcgatttagtgtgagtagtttgggttggggatcttaaaagaggttctttctctgggatgtggcatgagacaaaactaacaagtcgaaggcaggaacgatgttgccatccacaacgtcagttcgggtttctgccttgcgttcctagggttcccacgccgggttccaaggggttgaaattcgtgaccttgacgttcacgtactccttacgacttttccaggtctacgtcgaaacgtcaaaaggtacaaacgtcaccaacttccggaacccgttacggaccgggtacctaggtaccgtaacgggttacggtaccggtttacggaaccggtttacgtaccgtttaaccggtaccccggtaggtacccgtaggacccgtaacggtaacggttaccgtaggttaccgtaacctaaccggtacccgtaaacgtcccctaacgtaccctaaggtaccttaacccggttactaccgggtacccttacccgttaacggttcccgttaccggtacccggtacgggtaccgttacggtaacggttcgtacggtacggtacgtacggtacgtaacgtccgtacgtactacctaccttacccactacgtacaaccgtgtaaaccgttcggaacggtacgaacggttacgtacgtagtaccgtacgtacccgtaacgtttaacgtaaccgtttatacccgttaagtacgtaaaccttaccgttaaccttaaacccggtaagtttacccgtaacttaaccgggtaaccttcggttaaacccgtccggtaacctacgggtaaacgtacggtagtaaccccggtaaggtaacgtaaacccggttagttaacccggtacgg

SEQ ID NO: 172873 - DNA, 753 bp, Homo sapiens
  misc_feature: GYAE6OF02GFUN6.27.78.H01.1.454.CMB.1.raw
tcagagcgtcgtctcacgaccggtgctcgatttagtgtgagtagtttggggtttggggatgagcaaaactgacaagtcaaggcaggaagatgttgccatcacaactcattgggtttctgctgctctgggttcagcctccaggggtgaaattgtgctgactcagtctccagacttttcagttctgtgactaccaaaggagaaagtcaccatcacctgccgggccagtcagagcggttggtacgtagctttaacacgtacgggtaaccagacaaggtaaacgccgaggtcgacgtcctaccgaaacgtcctcctataacttacgaagttactcgtacctttacccctaggtttcccctttaccgtcgggtacccgggggttccccccttacgggtaacgggtttaccggtacggttacgggaccgtaagggtttacgggtaagtttccgggttaacgggggtaacctacccgttacgttttacccaaccccgtactaaaccctaacgttactaacgtacgtaccggtacggaacgtcgtacggtaacgatcgtcgtacgaccttaattacgttaactcgtaactctaacgtacgtaactttaaccgttaaccttttacctacgtaagttacggtactaccgttaccttacgggaccgtaaagggtaccgtaaccggacgttacgggtaaataacggttaaaccgtagtaacggttacgaacgttcgacctacctaggttcttacggtacttaccg

SEQ ID NO: 172874 - DNA, 703 bp, Homo sapiens
  misc_feature: GYAE6OF02GESZH.27.78.H01.1.454.CMB.1.raw
  modified_base (260)..(260): a, c, t, g, unknown or other
  misc_feature (260)..(260): n is a, c, g, or t
  modified_base (362)..(362): a, c, t, g, unknown or other
  misc_feature (362)..(362): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgtcttactcagtctccagtactttcagtctgtgactacaaaggagaaagtcacatcacctgccgggccagtcagagtcggttgtagtagcttacacgtggtaccagnagaagccaggtacagtctaccaaacgtctcctacactacaagtatgtccttaccacgttcctctccgtacggggtcccctcgtaggttcctaaggtcggacnggtacggtatacgttacgggactacgtactttaccgtacccctacctaaccctaatacctaaacgtacgtacccgtaggggtaaacgtacgtaggaaagttaacgttcggtacttcggaaacccttaaatttaacgtttaactcggttactaacgtactaaacggtacgtttaaaccctttaaacctttaacccgttataacggttacgtaccttaaccgtaccgtttaccgggaccgtaaacgggtaaccgaaccgtaacgttacggaaagtaacgtaaaaccgttacggttaggtacgtctaccgtaccgactaacttccggtattccttcgttacccg

SEQ ID NO: 172875 - DNA, 966 bp, Homo sapiens
  misc_feature: GYAE6OF02H1R41.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctggttcagcctccgaggggtgaaattgtgctgactcagtctccagtactttcagttctgtgactaccgaaaggaagaaagtcaccatccacctcggccggaccgagtcgagtagcgttggtagtagtctacacgtggtaccagacagaacgccgtacggtacacgtacctaccgaaacgccttcctacgaactacctaaaggttacttacgtacccgtttacccgtacgtttccctttaccgttcccggtaaccgggttcccccgtacggttacgggtttaccgtacgggttacggaccggttaggtacgggtaccgtttaccgggtacgggtaacccgtaacgtttaaccgttttaccccgtaaccccccttaaccgaaacccgtaaccgtttaaaccgttaaaccgtttaacccggtacccggggtttaaacggggtaaccgtaccggtaaagggtaaacgtaacgttcccggtaacgttaccgttaaacccttttaaacgtttttaacccgtttaacgtttaccggttaaccgttacgaaccggtttaaccgtaaccgtttaaccccgtttttaaccgtttaaacccgtttaaccggttaaaggtttacccgttaaaccctttaccccgttaaacccgtttaccccggggtaaaaccccggtaaacgggggttaaccccttaaacccggggttaccggggtttaaacgggtaaaaccgggtttaaaacgttttaaaccccgggttaaacggtttccgggtaaccggttacccgtttaccgaccccgtttaaaccgttaccgttttacccggtttacccgtttaccggttttaaaccccg

SEQ ID NO: 172876 - DNA, 802 bp, Homo sapiens
  misc_feature: GYAE6OF02I6Y9D.27.78.H01.1.454.CMB.1.raw
  modified_base (119)..(119): a, c, t, g, unknown or other
  misc_feature (119)..(119): n is a, c, g, or t
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
tcagagcgtcgtctcacgaccggtgctcgatttagtgtgagtagtttgggtttgggggcatgagcaaaactgacaagtcaaggcaggaagatgttgccatcacaactcattgggtttcngctgctcgtgggttccagcctccgaggggtnaaattgngctgactcagtcctccagtactttcgagtcgtgtgacctaccgaaaaggagtaaacgtccaacctatccgaccgtcggacccgggacctagtaccgaaggtaggtcggtttaggtacgtacgtacgttaacctacgtccgggtaaccacgtacgaagaacgtccgagtcgacgtaccctacgaaacgcccttcctactacgtacgtaagtcgttccgtccgttacctacgttccttcgtacccggtaccgggtcccgttacggtacggttcgacgtcggaccgtaggtagtacgtaccggtaggtacctaacgttacctttcccgtaaccaccgttaccacgtttacgaacgttccgtacgtacgtacgtacgtacgtacgtagttacgtacgtaacgttaccgttaacctttacgttaacgttccgtacgtacgtacgttaaacggtaccgtttaacctttaccgtttaaccgtaacgttaagttaccgttaaccgttaccgtaacccggtttaccggaaaccggtaaccggtaccgtaaccggtacggttaacggtaaccggtaaaccgttaacggttaaccggttcggtacgggttaaccctcggtaaccctaaccgttaccggttaccgttccttaacccg

SEQ ID NO: 172877 - DNA, 761 bp, Homo sapiens
  misc_feature: GYAE6OF02J1U6T.27.78.H01.1.454.CMB.1.raw
  modified_base (232)..(232): a, c, t, g, unknown or other
  misc_feature (232)..(232): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctcgtgggttccagcctccgaggggtgaaattgtcgctgactcagtctcagtacttcagtctgtgactccaaaggtanaacgtccacactccaccgttcggcccggacacggtccagtacggtcgttacggtagttacgccttacgaccgttaggtacccagaccaaggaacgccggtagtcctacggtcctaccgaaacgtcctccctactacgtaccgtaaggttactcgtaccccttacccgtaacgtttcccgtttaacgtcccgggtaacccggggttccccgtacggttaacggttcgtaacgggtcgacgtagggtcgtaacgttcgtacgggactacgtacctttccgaccctaccgactaactacgaaccgtgtaccgtagtacgtacgttagaacgtacgtcgtaacgtacgtacgttaaactttacgttaccgtacgttacgtaaccgtacgtaacgttaaccgtttaacccttaccggtttaccctaagttaccgtaacggttacccttaccgtaaccccggtttaccggaaccggaaccgggtaaccggtacgttaaccggtaacggtaaccggttaaaccgttaaacccgggg

SEQ ID NO: 172878 - DNA, 652 bp, Homo sapiens
  misc_feature: GYAE6OF02HXQ6Q.27.78.H01.1.454.CMB.1.raw
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
tcagagcgtcgtctcacgaccggtgctcgatttagtgtgagtagtttgggtttgggatcttaaaagaggttctttctctgggatgtggcatgagcaaaactgacaagtcaaggcaggaagatgtgccatcacaactcattgggtttctgctgtcctctgggttccagcctccgagggtagaaattgtgcctgactcagtctccagtactttcagtctgtcgactacgaaagganaaacgtcaaccnctacaccgtgacccgggacagtcagngtacggttggtagtaggtacttacacgtacggtaccagacgacggacgaccgtaggtacacgtactaccgaaacgtcctacctacacgtacaacgttatcgtcttaccgtaacgtcccttcgtaccgcggtccccgtacgtacgtcacgtggctacgtgtagtcgtacggactactacttccgaccctactacctataactacgtacgccggttaacgagtacctaggaacgtgtacgtcaagttacctaactttacttcgttatacgataccgtaattacgttacctttaaccttaccgttactaggtaacctacttaccggtaaccgtccgtaagaacggtaccgtaccgaacggttacgaaggttaaccttaaacgg

SEQ ID NO: 172879 - DNA, 604 bp, Homo sapiens
  misc_feature: GYAE6OF02F259E.27.78.H01.1.454.CMB.1.raw
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
  modified_base (518)..(518): a, c, t, g, unknown or other
  misc_feature (518)..(518): n is a, c, g, or t
tcagagcgtcgtctcacgaccggtgctcgatttagtgtgagtagtttgggtttggggggcatgagcaaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctcgccgggccagtcagagcgttggtagtagcttacactggtaccagacagaagccgaggtcacgtctaccaaacgcctccacatcaagttctcgtccttcccacgttccttcgtccgtaccggggttcccctcggtacggttcagtggggcaggtggatcgnggactactactttccaccctccaccatcaacgtcgaccgtaggaacgtcgaggtaaacgngtcgacgtacgtacctaacgtttacttacgtcgtacctaagtcctaagtaccgtttaacttacctttaacctagtaacgtntacttcctaaccgtcgacgaaggaccacgacgtagtacgtaacgttaaacgacgttgacgtctacgacctacgacttccgtattcc

SEQ ID NO: 172880 - DNA, 850 bp, Homo sapiens
  misc_feature: GYAE6OF02IAQSJ.27.78.H01.1.454.CMB.1.raw
  modified_base (135)..(135): a, c, t, g, unknown or other
  misc_feature (135)..(135): n is a, c, g, or t
tcagagcgtcgtctcacgaccggtgctcgatttagtgtgagtagtttgggtttggggagtcttaaaagaggttctttctctgggatgtggcatgagacaaaactgacaagtcaaggcaggaagatgttgcatcanaactcattggttctgctgctcgtggttccagcctcgagggtagtaattgtgctgactcgagtctccagtacttcgagttctcgtcgtacctaccgtaaaaggacgtaaacgtccaaccgtactcgaccgtcggcccggctagtcaaggtacgtcggttaggtacgtacgtacttacgacgtacggtaccacgacgaagaacgaccgtaacggtcctaacggtacctaaccgaaacgtcctaccgtactaacgtacgtaaacgtacgttaccgtacccgttacccgtaccgttcccttaccgtaccgggtaccccggttaccccgtacggtacggtttaccggtaacgggtcggtaaacggtacggttaacggtaccgttaccggttacgggaacccttaccgttttacccgttaccccgaaacccctaccgtaaaccttactaaccgggtaaacttccgggtacccttaaagggacgtacgttaaacggaagttacgtcgtaaccgtaagttaacccttaaagttttacgtccgttaacacgttacttaaccgtaacggttaaactttaacccgtttaccgtttacccgaaaaggtttcgtaaccccttaagggttacccccgtaacccgggtttaaaccccgggaaccgtaacggggtaaccccttacggggtaaaccggtttaacggtaaaacggttaacccttaaaaccggg

SEQ ID NO: 172881 - DNA, 857 bp, Homo sapiens
  misc_feature: GYAE6OF02FZP1J.27.78.H01.1.454.CMB.1.raw
  modified_base (192)..(192): a, c, t, g, unknown or other
  misc_feature (192)..(192): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagttggtttctgctgtctcgtgggttccagcctcggagggtagaaagtttcgngctgactcgtacgtctaccgtagttacctttcgaacgttcgttcgtacgtaaccgtaccgaaaagggtaacgtaaacgtaccaacctacttaccgaccgtcgggccggacctagtaccgaaggtacgtacggtttagggtaagttacgtaccttaacgacgttacgggtaaccacggacgtaacgaacggtaccgtaacggccgttacgtaccgtaaccgaaacgttcctacccgtactacgtaacgtaacgttactccttacccgttacctaccgtttccgttacggtacccgggttacccgggttcccgttacggttacggttacgacgggttccgtacggtacgggttaccgtacgtttcggtaaccggtaccgttaacgttcccttacccgaccgtactaacccgtatacgtacgtaccgtaccggtagaaacgccgttaacgtacggttgttaccgtacgtacggttaacttaacgtttaccgttaccgttaacgccctttaagtaaaccgttacggttttaaaccgttaacccgtttttaaccgtttaccgaacccgtttaaagttttccggaaacccgtttcccggtaaacgttacccgggaaacgggtacggtaaccggttacggtaccggtacggttaaacctaaggttaacccgg

SEQ ID NO: 172882 - DNA, 969 bp, Homo sapiens
  misc_feature: GYAE6OF02HVW2U.27.78.H01.1.454.CMB.1.raw
  modified_base (150)..(150): a, c, t, g, unknown or other
  misc_feature (150)..(150): n is a, c, g, or t
  modified_base (181)..(181): a, c, t, g, unknown or other
  misc_feature (181)..(181): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccgaggggtnaattgtgctgactcagtctccagtactttcngtctgtgacctacaaaggagtaagtcaccatccacctgccggccagtcaggagtcgttaggtagtacgtcttaacgacgtacggtaacccagacaacggaacgtccctacgggtacctacggtacctaccaaacgccttaccctcactaccgtaacggtactcggtaccctttacccgtacgttcccctttacgtccgggtacccgggttacccccgtcggttaacggtttccggtagggttcgggtacccgttagggttacgggtaaccgtttccgggtaaccggggtaaacccttacctttaacctttacccccgtacccctttaacccgaaacccttaacttaaacccgtaacggttaaccgggttaccccgttaaacggggtaaccggtaccgttaaacgggaaacggttagttccggggttaaccttaaccggggttacccttttaaaacccggttttaacgttttaacccggtttacggtttaacccttaaaccggtttacccgtaaacgggttttaaccctttaccggttttaaaacccttttaccccgttaacggttaaaccggttacgttaacccgttttaacccggtaccccggttttaacccggggaaacccggttaaaccggggtaacccgttacggggttaaaccgggttacgggttaaaaccgggttaaaccggtttaaaacccggtaaccgggttttacggtacccggttaccgtttaccgggaacccgttaaacccgttaccgggttttacccgttaccgttttaaccccgg

SEQ ID NO: 172883 - DNA, 684 bp, Homo sapiens
  misc_feature: GYAE6OF02H3X65.27.78.H01.1.454.CMB.1.raw
  modified_base (89)..(89): a, c, t, g, unknown or other
  misc_feature (89)..(89): n is a, c, g, or t
  modified_base (107)..(107): a, c, t, g, unknown or other
  misc_feature (107)..(107): n is a, c, g, or t
  modified_base (125)..(125): a, c, t, g, unknown or other
  misc_feature (125)..(125): n is a, c, g, or t
  modified_base (146)..(146): a, c, t, g, unknown or other
  misc_feature (146)..(146): n is a, c, g, or t
  modified_base (178)..(178): a, c, t, g, unknown or other
  misc_feature (178)..(178): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (466)..(466): a, c, t, g, unknown or other
  misc_feature (466)..(466): n is a, c, g, or t
tcagagcgtcgtctcacgaccggtgctcgatttagtgtgagtagtttgggtttggggatgagcaaaactgacaagtcaagggcaggaanatgttgccatcacaactnattgggtttctgctgctntgggttccagcctcaggggtnaaattgtgactgactcagtctccagtactttnagtctgtagactaccaaaggagaaagtcaacatcacctgcccgggcaggtcagacggtcgttaggagtanacctttaacncctggtaccagacagaagccaggtcagtctaccgaaatctcctcagtcaagtatcgtaccttcccacgttccttctaccgacgggttcccacgtggttacgaggttggacgaggtcgggtactacgttgggaacctacgttaacttaccacccttacaacctaactactaaaacgtacgaccgttaggaaacggtcctaagggtaaanagtacggacctagtaacctaacttttaaactacttacggtataacttacaacgtaacgttaccttaactttacccgttagtaacgtacgtactacctaccgttaccgggaccttaaaccggggaacgtaacgtaccggtaaggaaacggttaaaattaaaccgtaacgttaggtaacgggccgtttacgactaacctaccgtacgttgttaccttccg

SEQ ID NO: 172884 - DNA, 788 bp, Homo sapiens
  misc_feature: GYAE6OF02IJM5Z.27.78.H01.1.454.CMB.1.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcagtttggttctgctgctcgtggttccacgccgtccgagggtagaattcgtgctgtactcgtacgtccgtaccgagtactttcgacgttctgtcgtacgacgtaaaggaagtaacgtccaccgaactccgaccgtacggccggacctggtcgaaggngtacggttcggtaagttgtacttacgtacgtcgtaccgngacgaacgaccgacgaggtccgacgtacctaccgaaagtcctctaccgtataacgttaacgtcgttacgtacccttaccgtaccgtttccccgttagtacccggttaccgggtccccgttaggttaacggtttccgaggttcgactacgggttacgcgttccgtacgtaccgtacgttaactacccgtaccttaccgtaccgtacttaccgtaacgtcgtaccggttaggtaaccgttacgaggttaaaccggtacttacgaccggttacctaacgtttaaacgtttaccgtaactttacggcttacgtaaaccggttaggtaaacccgtttacgtaacccgtttacccgttagtaaccggttaccttaacccggttccgtttaacccggttacggtaacccggggtaacgtaccgtaacccggtaaggtaaccgttacgtaaacgttaaacgg

SEQ ID NO: 172885 - DNA, 779 bp, Homo sapiens
  misc_feature: GYAE6OF02GF9EF.27.78.H01.1.454.CMB.1.raw
  modified_base (150)..(150): a, c, t, g, unknown or other
  misc_feature (150)..(150): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttcngctgctctggttccagtcctccgaggggtgaattgtgctgactcagtctccgagtactttcagtctgtgacctaccgaaaaggagaaacgtccaaccacttaccaccgttacggcccgggacctaggtccaaggacggtacggtttcgggtaaggtagtaccttaaccgacgttcggtaacccgagccgtaaaggaacgtaccgtagggtaccacgtaccttacccgaaaacgccttaccctacgtaactacgtaagtacttacggtccttaccccgtacgtttacccgtttccgtacccgggttaccgggttaccccccgtttaggtaacgggtttaccgtaaacgggttcggtacgtaacgggttcggaacgttttccgggaacggggtaccctaacgtaaccgttttaccccaccccttaacacccgtaaacttaactaacgttaccgacgttacgggaaacgttcgtaagaaccgtagtacgtaccgtacgttaactaaacgtttacgttacgttcgtacttacgacctagtaacgtttaccgttactttaccgtacgtaagtctactaccgtaccgtagcccgtaacggtaccgtacgaagtacggttacgaaggtttaacccg

SEQ ID NO: 172886 - DNA, 899 bp, Homo sapiens
  misc_feature: GYAE6OF02ICS2H.27.78.H01.1.454.CMB.1.raw
tcagagcgtcgtctcacgaccggtgctcgatttagtgtgagtagtttgggtttgggatgagcaaaactgacaagtcaaggcaggagatgttgccatcacaactcattgggtttctgctgctctgggttcccagccctccgaggggttacgaaattggtgctagctcgacgtctcccagtacctttcagttctgtcgacctaccgaaaggacgaaacgtcaacctatccgaccgtcggcccgggctagttccaaggtagtcggttaggtagtacgtaccttaacgtactcggtaaccagcgaacgaacgccgaggtccacggtcctaaccaaagtcccttacgtacacgtacaagttactcgtaccttccgtacttcctacgtccggtacggtcccctcggtacggtttacaggtcggtacaacggtgtacgtacggtacggtacccacggttaactttacccaccccgttagttaacccacgtttacccgaaaggtccgtaaccggtaggtaacggtaccgtttaaggaacgttaacggtccgttaacggtacccggttaaactttaaccggtttaacgttaccgttaacgtttacccgaactttaaccggtaacggttaaccggttttaaacccctttacggtttaaaccggttaccggtaacggttaccttaacccggtaaccgttttacccggttacccggggaaacccggtttaaaccggggttcccaaaacccggggtttacccgtacggggttaaaaccgttaaaaaccgggtttaacccgggtttaaacggtccggttttaaacccgggggacccttttaaccggggaacccctacccgggtttttaaaccggtttaacccgttttcccgggttaaccccttttaaccccgg

SEQ ID NO: 172887 - DNA, 822 bp, Homo sapiens
  misc_feature: GYAE6OF02HDRKF.27.78.H01.1.454.CMB.1.raw
  modified_base (120)..(120): a, c, t, g, unknown or other
  misc_feature (120)..(120): n is a, c, g, or t
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (456)..(456): a, c, t, g, unknown or other
  misc_feature (456)..(456): n is a, c, g, or t
tcagagcgtcgtctcacgaccggtgctcgatttagtgtgagtagtttgggttggggatcttaaaagaggttctttctctgggatgtggcatgagcaaaactgacaagtcaaggcaggaanatgtgccatcacaactcagtttgggtttcngctgactcgtcgggttacccaggtcccttaccgagggggttataaatttggngaccgttgacctcgagtcctccgaagtacttttcgagttctggtacgacctaccgaaaaggtagtaaacgtccaaccagttccaaccggtcggccggtacacggtacagggacgtcggttacggagttacgtaccgttacgacgtacggttaacccagtacgtaacggaaccgtcgtacggtacgacgttccaaccgtaaacgccttacgactacgtacgtaagttctaccggccttaccgacgttccgtaccncgggttaaccgggtcccctagggtacgttcgtagtggtacgaggtagtacgtcgtacggactactccgttacccaacctcgtaccctataccgtagtaccggtcgtaacgagtccgtaaggaacgtgtaacggtccgttaacgaccgtttaacgtttaaccttcggtaaccgtacgttacgtaaacccggtaacgtttaaaccggttaaccgtttaacccgttttacaaccggtttaacggttaccgttaacccggttacggtttaaacccccggttaacccgggaacccgggttaaacccgggttaaccggtaccgggtttaaaccggttaacggggtaaaccgttttaaacggtaaaccccggg

SEQ ID NO: 172888 - DNA, 795 bp, Homo sapiens
  misc_feature: GYAE6OF02FOFOU.27.78.H01.1.454.CMB.1.raw
  modified_base (157)..(157): a, c, t, g, unknown or other
  misc_feature (157)..(157): n is a, c, g, or t
  modified_base (186)..(186): a, c, t, g, unknown or other
  misc_feature (186)..(186): n is a, c, g, or t
tcagagcgtcgtctcacgaccggtgctcgatttagtgtgagtagtttgggtttggggatcttaaaagaggttctttctctgggatgtggcatcgagcaaaactgacaagtcaaggcaggaagatgttgccatcaacaactcatttcgggtttactcnctgctctgggttaccagcctcgaggggtnaaattgcgtctgactcatcctcagtacttcagttctgtacgaactccaaaaggacgtaaacgtccgaaccagttaccaaccgttcggacccggtaccaaggttccgaagtaggtccggtttaggtaacgtagtaccgttaaccaccgttacggtaaccctaagacaaacggtaaacggtaccctaggggtacctaacggttcccgtaacctaaaacggcccctttaacccgacgtaacgttacggtaaacgtttacgttaaccgtccctttaaccccgtaacggtttacccgtttaccgtaccggtaacccgggggttaccccctttaagggtaacgggttttacccaagggttaccgggtacgtaacggttaccggtaagtttacccggtacggggtaacctaccgttaccgtttaccgaccccttacgaaccttacgtaccaacgttcgaccggtaggtaacgtccgtagaaccggttagtccgactacgtaactaattaacttacgtagtacgtaactacgagtaacgttacttacgttactacgtagtcttaacgtactacgtaccgacgtaacggacctaacgtcgtaagaccgtaactaacgg

SEQ ID NO: 172889 - DNA, 746 bp, Homo sapiens
  misc_feature: GYAE6OF02HSOMY.27.78.H01.1.454.CMB.1.raw
  modified_base (369)..(369): a, c, t, g, unknown or other
  misc_feature (369)..(369): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctcgtgggttccagcctccgagggggttagaaagttggtgctgactcagtctaccagtactttcagtctgtacgactaccgaaaggaagaaagtccaaccatcaccgtcggccgggcagtccaggagtcggttaggagtagtctacacgtcggacagcagaagtcgaggtcacgtctaccaaagctacctagataccaagtactcgtccttccattcctcgtcgaccgggtccctgtacggtcaggnggtccaagtcgtagtcggtaggacctaactacgtttacccaccctctaaccctagtacctaaagaccgtaccgtaggaacgtacggtaacgaagtacgtagtccgtaacggtaaccttaacttttaacgtccgttaacggtacctaagttaaccggtaacggttaaacgtttaccctttaaaacccgtttacccgttaaacggaaacgtttagttaacccttacccgttaacgggtttaccccgggaaaccggtaaacgggtaaccgtaccgggtaaccggttacgggtaaacgaaaacggttttaaaccggaacggttcgggttaacgtccggttacgaccctaccgttaacgtccggtactttaccggttaaccc

SEQ ID NO: 172890 - DNA, 714 bp, Homo sapiens
  misc_feature: GYAE6OF02FRVO8.27.78.H01.1.454.CMB.1.raw
  modified_base (180)..(180): a, c, t, g, unknown or other
  misc_feature (180)..(180): n is a, c, g, or t
  modified_base (235)..(235): a, c, t, g, unknown or other
  misc_feature (235)..(235): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccgaggggtnaaattgtgctgactcagtctccagtactttcagtctgtcgactaccgaaaggaanaaacgtcaccataccaccgtcggcccgggccagtcaggtacgtcggtttggtagtacgtcttaacacttggtaccagacagaacgtcgacggtacacgtcctaccgaaacgtcctaccgtactactacgtaacgttatcgtaccttacccttacgttccccgtttcgtaccggtaccggggttcccctacggtacggttcgacgggttacggcgtaggttcggtaacgtccggtacggggtacctaacgttaccgtttacccacccttaacccacctaacttaacctaaacggtaccgtacccggtaaggtaaccgcgttaaggaacgtacgtacgtacttacgtaccttaacgtttacttacgttatacctaactacgtacgtaactttaaccttacctttaccaacgtacgtacgtacctaccgtacccgtaccgaacgacggtactaacggtacgtacggtacgtacgtaaaccgg

SEQ ID NO: 172891 - DNA, 936 bp, Homo sapiens
  misc_feature: GYAE6OF02H0FVC.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttggggtttggggatgagcaaaactgacaagtcaaggcaggagatgtgccatcacaactcagttgggtttctgctgctcgtgggttccagcctccgaggggtanaaagttggtgctgactcagtctaccgagtactttcattctaggtacgactaccgaaaagggtagtaaacgtccaacctacgtacccaaccggtccgggaccgggacctacgtacgacggtaggtacgggttaggtacgtacgtccttagaaccgttcggtaaccaggactaggaacgccgtaggtctacgtaccgtactaaacggtccctaccgtactaacgtacgtaacgttacgtaccgtacccgttacccgtaccgttttaccccttaccggtacccgggtaccccggggtttccccgtaaggggttacggttaccgtaaccggggttccggaccggttaagggtacgggttaccggttagggttaaccggaacctttaacttacccgtttacccggaaccccctacttaaaccacttaacccggtaaggttaacccggtaccgggtaacgggtaaacccgttcggtaaacggtaaacgtacgggtttacgtaaccgtttaaccggaaaccttttaaacgttacggtttaacgtaaccgttctaaacgtaccggttaagtttaaacccttaaccgtttaaccttaacggttaacctaacgttcgggtaaaccttcccgggtttaccgttaaccgggaaaccggttaaccgggtaacccgtaacgttaacgggtaacgggttaaaaccggtaacgggtttaaacccgttagggtaaccggtttaccggtacccaaccgggttaaccgtcccgttaaattttcgttaccccgtttagttacccccg

SEQ ID NO: 172892 - DNA, 639 bp, Homo sapiens
  misc_feature: GYAE6OF02I2TNN.27.78.H01.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaattgtgctgactcagtcctccagtactttcagtctgtgacctaccgaaagganaaagtccaaccatccacctggccgggccagtcagtagtcgttggtaagtagaccttacacgtggtaccagcaagaacgccaggtcagtcaccaaagcctcctcatacaagtntcgtccttccgacttccttcctcgacgggtcccctggacgttcgngcgcgagtgacgtcgtaggacacgtacttacctaccctaccacctaactacgtactaacgtcgtacggaacgtacgtacgtaagacgtagtcgtactacgtaaccttagtttaacgtacttacgtacgtactacgtacctacgtttaaccgttaacttacgtaacgtatactccgtaccgttaccgaccggtaacgacgaccgtagacggtaacgtaaacgttaaaccgtaacgtacgttacggtacgtcggtacctaccgtacgtacttacgtcttacccg

SEQ ID NO: 172893 - DNA, 712 bp, Homo sapiens
  misc_feature: GYAE6OF02JL5VN.27.78.H01.1.454.CMB.1.raw
  modified_base (151)..(151): a, c, t, g, unknown or other
  misc_feature (151)..(151): n is a, c, g, or t
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
tcagagcgtcgtctcacgaccggtgctcgatttagtgtgagtagtttgggtttgggggcatgagcaaaactgacaagtacaaggcaggaagatgttgccatcacaactcattgggtttctgctgctctagggttccagcctccgaggggtnaattgtgctgactcagtcncagtactttcngtctgtnactaccgaaaggagaatcacatcacctgccggcagtcagtagcgttagtagatcttanacgtcgtacngactagaacgccaggtaccacgtacctacgaaacgcctaccgctactacaagtatccgtccttaccctagtcccttacgtaccggtccgggtcccctacgggttcgttaccggagtacggtccgagttacggtactacggttacggactaccgttacttacctacccgttaccaccgtactaccgaacgtccgtaacgcggtaacgacggtaagaacgtgaacgtacgtaccgttaattaacgttacgtttaaccctaagttactacggtaacgtaacgtaccgttttaaactcccggtttttactaaccgtaacgttaccgttaaccttccgttaacccgtaccggttaaaccgaaaccgggtactacggtagtaccggttaaacgtacggttaacctaaggttacccgggtataccgggttacacccttaactcgggttaccttaggttacccc

SEQ ID NO: 172894 - DNA, 574 bp, Homo sapiens
  misc_feature: GYAE6OF02IQQW9.27.78.H01.1.454.CMB.1.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
tcagagcgtcgtctcacgaccggtgctcgatttagtgtgagtagtttgggtttggggagtgagcaaaactgacaagtcaaggcaggaagatgttgccatcacaactcattgggtttctgctgctctgggctccagcctccgagggtgaaaattgtgctgactcagtctccagactttcagtctgtgactccaaaggagtaaagcacatcgacctgccggccatcagngcgtggntacgntacncgtgtaccagnagagtcaggtcagtcnctaagctccgtcatcgaagtatcgcttccagtcctctcgacggtcccgtcgaggttcagtggactaggagtcgcttagggactacgactttcaccctctaacncgtacaactacgccgtagaagcctagaagatcgtatcgaccgtaattacgttactgtacattagacgagttactacctttacaccgtaaagtccgtatccgaccgttacgaccctaagggaccgtaccgtaacgtacggacgaaacgtttaaaccgaacgtttcgacggtacttacggacaccggtactacgtacgttacc

SEQ ID NO: 172895 - DNA, 638 bp, Homo sapiens
  misc_feature: GYAE6OF02F6FB6.27.78.H01.1.454.CMB.1.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagagcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtnaaattgtgctgactcagtctccagtactttcagtctgtcgacctaccgaaagganaaagtcaactatccacctcggcccggacagtcagacgtcgttagtagagcttancgtcggtaaccngacagaacgccagtcagtcacaanctctacactacaagtntcgtcctccacggttcctctaccggtacgggttccctaggtacgtttacgaggttcgacgtaaggtcggactcggagggacctacgttacttaccgaccctacgactaacgtaccaacgttaccgacggtaggaacgtacaggaactacgtcgactaacgtacgtaaccttacttactcgttatacgtacgaacgttaagttaaccttacctttaccaacgtaacgtccgtaactaccgtaaccgttaccggacgtacggaaccgtaacggtacgtaaggtaacttaagttaaaccgg

SEQ ID NO: 172896 - DNA, 903 bp, Homo sapiens
  misc_feature: GYAE6OF02JUIUV.27.78.H01.1.454.CMB.1.raw
  modified_base (88)..(88): a, c, t, g, unknown or other
  misc_feature (88)..(88): n is a, c, g, or t
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
  modified_base (197)..(197): a, c, t, g, unknown or other
  misc_feature (197)..(197): n is a, c, g, or t
tcagagcgtcgtctcacgaccggtgctcgatttagtgtgagtagtttgggtttggggatgagcaaaactgacaagtcaaggcaggaanatgttgccatcacaactcattgggtttctgctgctctggttccagcctccgagggtanaattgngctgactcagtctcagtactttcattctgtcgactacgaaagganaaacgtcacatcctaccgtacggccgggtactacgtaccaggtacgtacggttaggtaagtacgtacctttaacgacgttacgggtaaccaggtacaaggtacggtccgaaggttccaacggttccaaccgtaaacgtcctacccttacgaaacgttaacgaaacggtttactccgttacccttacccgtaacgtttcccgtttccgtacccggtaccggggttacccccttaaggggtcgttacggtacggttcggacgttaacgggtgtaacggttcggtacggtaaccttacgtacctttacccgacccttacgaaccctaagtacctaacggtaccggtccgtaaggtaaccgtagttaaccggaagtaccgtacggttactagttaaacccgttacttttaacgggtctaccgttacgttaccgttaaacggaacctttaaccggtttaaaccgtttaccccttaaaccggtttacggtaaaaaccgtttccggttaaaccccttaacccggtttccccgggtaaaccgtaaacccggggttaaccggtaacccggttaccgggtaccggttaaacgggttaacccggtaaaacgggttttaaacccaaacggggttccgtttaaacccggtaccggttaccggtaacccttaaaccggtttccggttacccgtttttacgggtacccccttttaacccgg

SEQ ID NO: 172897 - DNA, 758 bp, Homo sapiens
  misc_feature: GYAE6OF02G36RK.27.78.H01.1.454.CMB.1.raw
  modified_base (147)..(147): a, c, t, g, unknown or other
  misc_feature (147)..(147): n is a, c, g, or t
  modified_base (282)..(282): a, c, t, g, unknown or other
  misc_feature (282)..(282): n is a, c, g, or t
  modified_base (696)..(696): a, c, t, g, unknown or other
  misc_feature (696)..(696): n is a, c, g, or t
tcagagcgtcgtctcacgaccggtgctcgatttagtgtgagtagtttgggtttggggatgagcaaaactgacaagtcaaggcaggaagatgtgccatcacaactcattgggttctgctgctctcgggttccacgcctccaggggtanaaacttgtagctagactcacgtctaccagtactttcagtctgtcgactaccaaaggagtaaacgtcaaccaatccgacctcggcccgggtcaacggtcagagtcggttggtatacgcttaacgacgttggtaccngacaagagcctaggtcacgttctaccgaaagtcctctactatactaacggtacttcgtccttacccgacgttaccctttccggacggttaccggggttacccctaaggtcggtttaccgagggttccgacgtagggttactaggtacggtcggtaaccacgtttacttacccacccgtacaaaccctgtaactaacgctccggtaagagtactaaggaacgtgtcgtactacggtaaccttaatttactacctagtacccagttacccgaagttaccgtttaaccgttaaccgtttacctaacgaacgggtttactacccttaaccggtttaccccggtaaacggttacccgaaacgggtacccgaccgggttaagtaccgggtaaaacggttaaacccggttaaaaccgggtntaacccgggggttacgtaccgtacttaacccggaacctttgttcctttacgttcgttaaccc

SEQ ID NO: 172898 - DNA, 672 bp, Homo sapiens
  misc_feature: GYAE6OF02GKJKN.27.78.H01.1.454.CMB.1.raw
tcagagcgtcgtctcacgaccggtgctcgatttagtgtgagtagtttgggtttggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaagtcaaccatccaccgtgcccgggccagtcaggagtcgttggtagtagcttacgacgtggtaccagcagaacgccgaggtcagtcctaccgaaagcctcctcatacaagtatcgtccttcccacgtccttcgtccgacgggttcccctggtacgttcgagtggcaggtgacgtcgtggactactacgtttccacccgtacaccctatactaacgtacgtccgtaggaacgtacgagaacgtctggacctacggtaaccttaacgtttaacgtttacgtcgttaccgtaacttacgaagttaacctttaacctttaaccgttttacccaaggtaaacgttccgtaacttacccgtaaccgtttaccggaaccggtaaacggaccctaacggtaccgtagggtaacgtaaacgttaaaccgacgttggtaccgtacgttacgacctaccgttactcgtttaccgtcttaccg

SEQ ID NO: 172899 - DNA, 652 bp, Homo sapiens
  misc_feature: GYAE6OF02IMRJM.27.78.H01.1.454.CMB.1.raw
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (248)..(248): a, c, t, g, unknown or other
  misc_feature (248)..(248): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (528)..(528): a, c, t, g, unknown or other
  misc_feature (528)..(528): n is a, c, g, or t
tcagagcgtcgtctcacgaccggtgctcgatttagtgtgagtagtttggggtttggggatgagcaaaaactgacaagtcaaggcaggaagatggttgccatcaacaactcagttgggtttctgctgctcgtggttccngcctcgaggggtataattgngctgactcagtcctactagtactttcagttctgtactacctacaaagggaataaacgtccaacatccgtaccgtcggccggccagtcagngtcgttggtaagttcgaccttacgacgttcgacgagacgaacgacgaccgtaggtctacggtacctaacccgtaacgtcctcctactaacgtacgtaaattacgtcttccttcccgtaactttcccgttcgtaccggttaccgggttccccgtaggttacgtcgtagtcggacgtggtgtacggtcgtacggtactacttacttccaccgtctaactaactacaacgtcgcgtagtacgacgtanaacgntaacgtcgtactacttaacttagttcttanactatacgagttacttaccgtaacttcaacgtgtactctacgttccgtaacggaactaacggactacgatacggaattaacgtaacgacgttgacgttcacgtactcgaattctaggttctacc

SEQ ID NO: 172900 - DNA, 814 bp, Homo sapiens
  misc_feature: GYAE6OF02JMZ88.27.78.H01.1.454.CMB.1.raw
  modified_base (149)..(149): a, c, t, g, unknown or other
  misc_feature (149)..(149): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtnaaattgtgctgactcagtctccagactttcagtctgtgactccaaaggtagaagtcaccatccaccgtggccgggcaggtcacgaggtcgttggtagtgaccttacacgtcggtaccacggacaggaacgaccgtaggtctacggtcctaccgaaacgtcctacccttcgaacttcgtaaaggttcttcggtacccctttccctaacggtttcccctttccgtaccgggacccgggggttacccccttacggggttacggtttaaccgacgggttccggtagtaaccgggtgggtacgttacccggtacggggaacttaccgtacttttccccgaaaccctccgtaactaccttaacggtaaacggtcccgtacggtacggtaacggtacgttaaacggaacgtaaggtttcggaccggtactaaacccgttttaaacgtttacctttacggtaaccttccgtaaagttaccgtaaacgttaccgtttaaccgtttaacccttttacgtaaccggtaagttaccgtactttaacccggaccgttaccgggtaacccgaacgggtacccgtacgaccggtttaacggaaggttttaaaccttaacggaaccgtttacggagtacgttaccgtacgtaaccccgttaatcccgtttaccgtttaccg

SEQ ID NO: 172901 - DNA, 739 bp, Homo sapiens
  misc_feature: GYAE6OF02HKQ9A.27.78.H01.1.454.CMB.1.raw
  modified_base (152)..(152): a, c, t, g, unknown or other
  misc_feature (152)..(152): n is a, c, g, or t
tcagagcgtcgtctcacgaccggtgctcgatttagtgtgagtagtttggggtttgggggggcatgagcaaaactgacaagtcaaggcaggaagatgttgccatcacaactcattgggtttctgctgctctgggttccagcctccgaggggtnaaattggtgctgactcagtctccagtactttcacggtctgtgactaccaaagggacaaagtcaccatcacctgccgggcagtcaggagtcgttggtacgtcgcttacacgttcgtaccagcagacgccgaggtcacggtctaccgaaagcctacctacactactaacgttactcgtaccgttcccaccgttaccgttcctaccggtaccggggttccccttacggtaacggttcgacggttcggacgtagggtcgtagtacgtacggggaaccttactaactttaccctaccctacacctactactaacgtacggtccgtagggaacgtacgtacggaagtacgtgaaccgttggaacctttacgttaactttcgtacggttcaagttacgtacggttaactttacccttaacgttttaaccctacgttaaacgtcggttaactacccgttaccgttaccgggtaaccggaaaccgggtaccttacccggggttaaccgtacgggttaaaactaaaccggttaaaacgggtaacttcggggtacgtaccgttacgacccgtaaccctaggtttaccttaggttcccg

SEQ ID NO: 172902 - DNA, 836 bp, Homo sapiens
  misc_feature: GYAE6OF02FOPXU.27.78.H01.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagagcgtcgtctcacgaccggtgctcgatttagtgtgagtagtttgggtttggggggcatgagcaaaaactgacaagtcaaggcaggaagatgttgccatcacaactcattgggtttctgctgctcttgggttccagcctccgaggggtgtaaattgtgctgactcacgtctccagtactttcagtctgtnacctacaaaggagaaagtcaccatcaccncgggccggcagtcagngtcgttggtagtacgtcttacncgtagtaccagcgagaacgccgaggtcacgtctaccgaaagcctcctctactacaacgtatccgtacccttcccgtacgttcccgtttcgtaccgggtacccgggttcccccgtaggttacggttacgacgggttcggtacgtaggttacggtacgttaccggtacggggtaacctacggttaacctttcccctaaaccccgttccctaaaccgtaacttaacctaaaccggtaccggtaacccgttagggaacgtcgttaaaccgggaagtacgtacgtccgttaacgtacccttaaacgtttaacttttacggtcttaccgttaagtaccgtaacggtttacccgtttaacccgttttaaacccttttaacccgtacggttaaaccgttacgttaacccggtttaccttaaccccggttaacccgggtaaccggtaaacccggtaccggtaccggttaacgaacgggtaaaacgttaaaccggttaaacccgggttaaccggttacgggttaacggtccggttaaccgaaccccgtaacccgtttaaccgtttccgtttacggtttaacccccg

SEQ ID NO: 172903 - DNA, 718 bp, Homo sapiens
  misc_feature: GYAE6OF02G3U5P.27.78.H01.1.454.CMB.1.raw
  modified_base (522)..(522): a, c, t, g, unknown or other
  misc_feature (522)..(522): n is a, c, g, or t
tcagagcgtcgtctcacgaccggtgctcgatttagtgtgagtagtttgggtttggggatcttaaaagaggttctttctctgggatgtggcatgagacaaaactgacaagtcaaggcaggaagatgttgccatcaacaactctagttgggtttctgctgcgtcgttcgggttccacgcctccgaggggtataattgtcgctagtactccagtcctccctagtacctttcgacgttcgtgtacgacctaaccggaaaggtaacgtaacgtaccactactcccaaccgtccgggccggactcgtacgacgtaggtcggttacggttaggtacgtaccttaccgtacgtcggtaacgacgtacgaacgaacgacgtaggtcgacgtcctaaccgtaacgtcctacctactactataaggtcgtccgtaccttaccgtccgtttcccttacggtccggtacccggttacctacggttcgtcgtagtacgtacgtacgtggtacgtcgacgtactacgttcttacccnccctactacatacgtacgtacgcgttaagacgtacgtacgtaagtcgtacgacgttagacctttaacgtcgttacttacgacttaacgtacgtaacgtttaccgttaacgttaccttacgtacgtaacgttaccgtacttaccgtaccgttacgggacctacggaccgtacgtacgtaacgttagtacccgtaacg

SEQ ID NO: 172904 - DNA, 826 bp, Homo sapiens
  misc_feature: GYAE6OF02G6HIV.27.78.H01.1.454.CMB.1.raw
  modified_base (90)..(90): a, c, t, g, unknown or other
  misc_feature (90)..(90): n is a, c, g, or t
  modified_base (101)..(101): a, c, t, g, unknown or other
  misc_feature (101)..(101): n is a, c, g, or t
  modified_base (150)..(150): a, c, t, g, unknown or other
  misc_feature (150)..(150): n is a, c, g, or t
  modified_base (533)..(533): a, c, t, g, unknown or other
  misc_feature (533)..(533): n is a, c, g, or t
tcagagcgtcgtctcacgaccggtgctcgatttagtgtgagtagtttgggtttggggatgagcaaaactgacaagtcaaggcaggaagangttgccatcanaactcagttgggtttctgctgctcgtgggttccagcctccgaggggtanaaattggtgcgtgactcagtcctaccagtactttcgagtctgtagactaccgaaaggagaaacgtccacatccaccgtgcccgggaccagtcgagtacgtcgttaggtagtagtaccgttacacgtcgtaccgagtacgaggaacgcgaggtcagtaccacaaacgtcctacctacgactactaagtactcgtcccttaccctacgttccttaccgtaccggtaccgggttcccccttagggtacggttacgtacgggtcgggaccgtaggttcgggacgttaccgggacggtaacctaaccgttacttcccgtaacccctacctaacccgtaactaccgtaaacgtaccgtcgtaacgggaactacggaagtaaacggtacncgtaacgtcgaaacgtttaaccttacgtaccgttactaccgttaacgtaccgttaacgtttaaacctttacccggtttaaccgttttaccgtaaccggttaacgtttacccggttaaaccttacccccggttaaccgtttaacccgggtaaacccggtaaccggtaaccgtaaccgggttcgttaaacggtaaaacccggtttaaacggttaaaccggtcggttacggttacccggtaccgttaacccgaccctttaaaaccgtgttaacccgtttgttaccgtttaaacccc

SEQ ID NO: 172905 - DNA, 827 bp, Homo sapiens
  misc_feature: GYAE6OF02ITATA.27.78.H01.1.454.CMB.1.raw
  modified_base (248)..(248): a, c, t, g, unknown or other
  misc_feature (248)..(248): n is a, c, g, or t
  modified_base (443)..(443): a, c, t, g, unknown or other
  misc_feature (443)..(443): n is a, c, g, or t
tcagagcgtcgtctcacgaccggtgctcgatttagtgtgagtagtttgggtttggggggcatgagcaaaactgacaagtcaaggcaggaagatgttgccatcacaactcattgggtttctgctgctcgtgggttccacgcctccgaggggtagtaaattgtgtctgtactcacgtcttaccagtactttcagtctgtagactacgaaacggagaacgtacacactcaccgtcgccggctacgtacagngtcgttggtagtagtcttacacgtcgttaccgagacgaacgaacgaccgtacgtacgacgttactaaccgtaaacgccttaccctacgtaactacgtaacgttacgtctcccgttaccgtaccttccgttccgttaacggtccgggttaccccgttaggtacggttcgtaaggttcggaccgtaggttaacggtnttcgacggttaacctaccgttacgttacctacccgtaacctaccgacttaaccgtaactaccggtacgtaacggtaacggtaacgttaggaaaccgtcgttacggtacctaaacggttaactaacccgttttaaagttttacgtaccgtataaacccgcgttaaacggtacccttttaaaccgttttaaacccgtttaccgtttaacgaaaactttccggtaacccttaaccggttttacccggtaaaccggtaccggaaaacccgttccgttaaacggacggtttaaccgggtaaaccgttttaaaacggaacccgtttaagttaaccgggttcgttaaccggtacgtaccggtaaccctacggtttctttaacgtttccccg

SEQ ID NO: 172906 - DNA, 764 bp, Homo sapiens
  misc_feature: GYAE6OF02G5HKI.27.78.H01.1.454.CMB.1.raw
  modified_base (88)..(88): a, c, t, g, unknown or other
  misc_feature (88)..(88): n is a, c, g, or t
  modified_base (326)..(326): a, c, t, g, unknown or other
  misc_feature (326)..(326): n is a, c, g, or t
tcagagcgtcgtctcacgaccggtgctcgatttagtgtgagtagtttgggtttggggatgagcaaaactgacaagtcaaggcaggaanatgttgccatcacaactcattgggtttctgctgctctgggttccagcctccgaggggtgaaattgtgctgactcagtctccagtactttcagtctgtgactaccaaaggagaaacgtcaacctatccacctcggcccgggccagtcagacgtcggttaggtagttacgcttaacgaccgtggtaaccagacaagaacgccgaaggtccacgtcctaccgaaacgccttccacaactanaagtactcgtccttacccgtacgtttcccttcgtaccggtccgggttcccctgggtacggttcgaggtcggtacgaggttcggtacgttacggtacgggtaactaccttaccgtttacctaacccctaccgtaacctacttaacctaacgttacgaccgtaacgggtaacgtaccgtaaggaaacgtcgtacgtccgttactaaccgtttaaacgtttacgttacgttcgtaacttacgtacgtaaacgttacgtttaaccttacgttttaacccgagttaacgtagtaccgttacccgttaaccgggtaccggaaaccggtaaacggaaccgttaacggacggttaacggtaacggttaaaccgttaaaccggtaaggttacgggacgttacgtaccggaactacccgttaggttcgttaccgtttccttaacccgg

SEQ ID NO: 172907 - DNA, 753 bp, Homo sapiens
  misc_feature: GYAE6OF02HOKON.27.78.H01.1.454.CMB.1.raw
  modified_base (147)..(147): a, c, t, g, unknown or other
  misc_feature (147)..(147): n is a, c, g, or t
  modified_base (187)..(187): a, c, t, g, unknown or other
  misc_feature (187)..(187): n is a, c, g, or t
tcagagcgtcgtctcacgaccggtgctcgatttagtgtgagtagtttgggtttgggggcatgagcaaaactgacaagtcaaggcaggaagatgttgccatcacaactcagttgggtttctgctgctcgtgggtcagcctcgagggtntaaattgtgctcgactctcgtctccagtactttcgagttntgtcactacgaaaggagaaacgtcaaccactaccgtaccgtcggaccggacctagtcgaagtcggtcgggtttaggtacgtacgtcttaccgacgtacggtaccaggacaaggacgtaccggacggtctacgtaccgtaaccaaacgtccctctaactacttaacgtaagttacgttaccggtccttacccgttacgtttaccctttaccggtacccgggttaacccggggtttccccttacgggttaacgttcgggtacggtcggagttacggtacggtacggttacgtaccggacttaccgttacttaccccgaaccttaccgtaactacgtacttaacgttaccggtaacgtaggtaacgacgttaggaaatcggtacgacttacggaacttaacgtttacttacgtcttactacgtacgtaacgtacctttaccttaacgttaccctaagtacgtactacctaccgtaccgtaccgaacggtacgtaccgtacgaacgtaagtaacgtaaccgttacgtacgttcgagtccggtacaccgttacgtacttcgtacccttacg

SEQ ID NO: 172908 - DNA, 755 bp, Homo sapiens
  misc_feature: GYAE6OF02F28VJ.27.78.H01.1.454.CMB.1.raw
  modified_base (237)..(237): a, c, t, g, unknown or other
  misc_feature (237)..(237): n is a, c, g, or t
tcagagcgtcgtctcacgaccggtgctcgatttagtgtgagtagtttggggtttgggggatgagcaaaactgacaagtcaaggcaggaagatgttgccatcacaactcattgggtttctgctgctctgggttccagcctccgaggggtgaaattgtgctgactcagtctccagtactttcagtctgtgactaccgaaaggagaaagtcaccatccgaccgtcgccgggccagtcagnggtcgttggtagtagcttacacgtcggtaccagacacgaagccgaggtcagtacctaccaaacgtctcctactatacaagttactcgtacccttccctacgttccttccgtaccggtaccgggttccccgtacggttacggttaccgtaggtcggtacgtacggtggtacgtacggtacgggacctacttaccgtttaccacccgtacctaacctaacgtacgtaacgtacgtccgtaaggaaacgtcgtaaggaagtcgtacgacgttacgttaacttaaccgtttacgtttacgttaagtaccttaacgttaccgtaaaggttactttaaccctttaaccctttacgtaaccgttaacgggtaacttaccgttaccgttaacccgtacggtaaacccggtaacgggaacgtaaccgtacgggtaaggtaacgttaaaacggttaaaccggtaacggttaccggtaaggtcccaacgttcctaaccgttacgttaccgtttccgtttaccgttaccg

SEQ ID NO: 172909 - DNA, 125 bp, Homo sapiens
  misc_feature: GYAE6OF01CZZ45.3.52.E08.1.454.CMB.1.raw
  modified_base (125)..(125): a, c, t, g, unknown or other
  misc_feature (125)..(125): n is a, c, g, or t
tcagagacgcactccacgaccggtgctcgatttagtcgagctctcccgcgagagagctcgataaatctgcctggtcaaggactacttccgagtgcgtctctgagcgggctggcaaggcgcatagn

SEQ ID NO: 172910 - DNA, 125 bp, Homo sapiens; identical to SEQ ID NO: 172909
  misc_feature: GYAE6OF01DTA4D.3.52.E08.1.454.CMB.1.raw
  modified_base (125)..(125): a, c, t, g, unknown or other
  misc_feature (125)..(125): n is a, c, g, or t

SEQ ID NO: 172911 - DNA, 125 bp, Homo sapiens; identical to SEQ ID NO: 172909
  misc_feature: GYAE6OF01A76PR.3.52.E08.1.454.CMB.1.raw
  modified_base (125)..(125): a, c, t, g, unknown or other
  misc_feature (125)..(125): n is a, c, g, or t

SEQ ID NO: 172912 - DNA, 142 bp, Homo sapiens
  misc_feature: GYAE6OF01E2B58.3.52.E08.1.454.CMB.1.raw
  modified_base (141)..(142): a, c, t, g, unknown or other
  misc_feature (141)..(142): n is a, c, g, or t
tcagagacgcactccacgaccggtgctcgatttagtcgagctctcccgcgagagagctcgactaaatgacaccggtcgtgctgcctggtcaaggactattcccccgagtgcgtctctgagcgggctggcaaggcgcatagnn

SEQ ID NO: 172913 - DNA, 125 bp, Homo sapiens; identical to SEQ ID NO: 172909
  misc_feature: GYAE6OF02IFUCT.3.52.E08.1.454.CMB.1.raw
  modified_base (125)..(125): a, c, t, g, unknown or other
  misc_feature (125)..(125): n is a, c, g, or t

SEQ ID NO: 172914 - DNA, 154 bp, Homo sapiens
  misc_feature: GYAE6OF02I0VWE.3.52.E08.1.454.CMB.1.raw
  modified_base (126)..(154): a, c, t, g, unknown or other
  misc_feature (126)..(154): n is a, c, g, or t
tcagagacgcactccacgaccggtgctcgatttagtcgagctctcccgcggagagagctcgataaatctgcctggtcaaggactacttccgagtgcgtctctgagcgggctggcaaggcgcatagnnnnnnnnnnnnnnnnnnnnnnnnnnnnn

SEQ ID NO: 172915 - DNA, 133 bp, Homo sapiens
  misc_feature: GYAE6OF02I98O2.3.52.E08.1.454.CMB.1.raw
  modified_base (122)..(133): a, c, t, g, unknown or other
  misc_feature (122)..(133): n is a, c, g, or t
tcagagacgcactccacgaccggtgctcgatttagtcgagctctccgcgagagagctcgataatctgcctggtcaaggactacttccgagtgcgtctctgagcggctggcaaggcgcatagnnnnnnnnnnnn

SEQ ID NO: 172916 - DNA, 153 bp, Homo sapiens
  misc_feature: GYAE6OF01EQXGO.2.13.B02.1.454.CMB.1.raw
  modified_base (128)..(153): a, c, t, g, unknown or other
  misc_feature (128)..(153): n is a, c, g, or t
tcagacgctcgacacacgaccggtgctcgatttagtctagcgacttccgcgggctggcaaggcgcatagctgcatggtcaaggactacttcctgtcgagcgtctgagcgggctggcaaggcgcatagnnnnnnnnnnnnnnnnnnnnnnnnnn

SEQ ID NO: 172917 - DNA, 149 bp, Homo sapiens
  misc_feature: GYAE6OF01BJUU8.2.13.B02.1.454.CMB.1.raw
  modified_base (128)..(149): a, c, t, g, unknown or other
  misc_feature (128)..(149): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnnnnnnnnnnnnnnnnnnnn

SEQ ID NO: 172918 - DNA, 156 bp, Homo sapiens
  misc_feature: GYAE6OF01CWI6W.2.13.B02.1.454.CMB.1.raw
  modified_base (127)..(156): a, c, t, g, unknown or other
  misc_feature (127)..(156): n is a, c, g, or t
tcagacgctcgacacacgaccggtgctcgatttagtctagcgacttccgcgggctggcaaggcgcatagctgcctggtcaaggactacttcctgtcgagcgtctgagcggctggcaaggcgcatagnnnnnnnnnnnnnnnnnnnnnnnnnnnnnn

SEQ ID NO: 172919 - DNA, 135 bp, Homo sapiens
  misc_feature: GYAE6OF01BSOOP.2.13.B02.1.454.CMB.1.raw
  modified_base (129)..(135): a, c, t, g, unknown or other
  misc_feature (129)..(135): n is a, c, g, or t
tcagacgctcgacacacgaccggtgctcgatttagtctagcgacttccgcgggcgtggcaaggcgcatagctgcctggtcaaggactacttcctgtcgagcgtctgagcgggctggcaaggcgcatagnnnnnnn

SEQ ID NO: 172920 - DNA, 151 bp, Homo sapiens
  misc_feature: GYAE6OF01DWZC7.2.13.B02.1.454.CMB.1.raw
  modified_base (128)..(151): a, c, t, g, unknown or other
  misc_feature (128)..(151): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnnnnnnnnnnnnnnnnnnnnnn

SEQ ID NO: 172921 - DNA, 166 bp, Homo sapiens
  misc_feature: GYAE6OF01BH3XU.2.13.B02.1.454.CMB.1.raw
  modified_base (128)..(131): a, c, t, g, unknown or other
  misc_feature (128)..(131): n is a, c, g, or t
  modified_base (133)..(133): a, c, t, g, unknown or other
  misc_feature (133)..(133): n is a, c, g, or t
  modified_base (136)..(137): a, c, t, g, unknown or other
  misc_feature (136)..(137): n is a, c, g, or t
  modified_base (139)..(166): a, c, t, g, unknown or other
  misc_feature (139)..(166): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnngnatnntnnnnnnnnnnnnnnnnnnnnnnnnnnnn

SEQ ID NO: 172922 - DNA, 132 bp, Homo sapiens
  misc_feature: GYAE6OF01C0NM3.2.13.B02.1.454.CMB.1.raw
  modified_base (128)..(132): a, c, t, g, unknown or other
  misc_feature (128)..(132): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnnn

SEQ ID NO: 172923 - DNA, 664 bp, Homo sapiens
  misc_feature: GYAE6OF01EPD57.2.13.B02.1.454.CMB.1.raw
  modified_base (225)..(225): a, c, t, g, unknown or other
  misc_feature (225)..(225): n is a, c, g, or t
  modified_base (461)..(461): a, c, t, g, unknown or other
  misc_feature (461)..(461): n is a, c, g, or t
tcagacgctcgacacacgaccggtgctcgattttagtctagcgactttgggtttaggggaggaactaggcctaacagttacggaccctaggacggaaccactggaagccccagcgcacgcttcctcttccgtccgtcgcgtactctggtcctttccctaggataccactggagaaatagtgctcgacgccagttctccagccacctgtctgtgtctcgagggaangccaccgtctcctggccagggccagtcaggacgtgttagcggcaacgttagcctgggttaccagtcctacgaacgtcctggccaagtacgttcccgaaggcctccgttaccgtccgagtcggttgcgtagtccgaccgagggccagttggtactccccagacctaaggttcagtggcagtgggtctgggacagagttcactctcactatcgagcagcctgacagtcctagaacgtnttttacgcgtaagttttagttacgtggtcctagactagttataagtaacgtcggacccggttaggtaaccgttttccggaccgtaacggggaccgtaaaggggtacggtaaaacgttaacgtaaaacggtaacgtacggttacgggtcgttaccggtcgtaacccgtagttacccgttacggtttcctttgacgtttaccccg

SEQ ID NO: 172924 - DNA, 150 bp, Homo sapiens
  misc_feature: GYAE6OF01BQHGC.2.13.B02.1.454.CMB.1.raw
  modified_base (127)..(150): a, c, t, g, unknown or other
  misc_feature (127)..(150): n is a, c, g, or t
tcagacgctcgacacacgaccggtgctcgatttagtctagcgacttccgcgggctggcaaggcgcatagctgcctggtcaaggctacttcctgtcgagcgtctgagcgggctggcaaggcgcatagnnnnnnnnnnnnnnnnnnnnnnnn

SEQ ID NO: 172925 - DNA, 147 bp, Homo sapiens
  misc_feature: GYAE6OF02HNIMT.2.13.B02.1.454.CMB.1.raw
  modified_base (128)..(147): a, c, t, g, unknown or other
  misc_feature (128)..(147): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnnnnnnnnnnnnnnnnnn

SEQ ID NO: 172926 - DNA, 128 bp, Homo sapiens
  misc_feature: GYAE6OF02I2PP2.2.13.B02.1.454.CMB.1.raw
  modified_base (107)..(107): a, c, t, g, unknown or other
  misc_feature (107)..(107): n is a, c, g, or t
  modified_base (128)..(128): a, c, t, g, unknown or other
  misc_feature (128)..(128): n is a, c, g, or t
tcagacgctcgacacacgaccggtgctcgatttagtctagcgacttccgcgggctggcaaggcgcatagctgcctggtcaaggactacttcctgtcgagcgtctgancgggctggcaaggcgcatagn

SEQ ID NO: 172927 - DNA, 691 bp, Homo sapiens
  misc_feature: GYAE6OF02IX6J5.2.13.B02.1.454.CMB.1.raw
  modified_base (147)..(147): a, c, t, g, unknown or other
  misc_feature (147)..(147): n is a, c, g, or t
  modified_base (152)..(153): a, c, t, g, unknown or other
  misc_feature (152)..(153): n is a, c, g, or t
  modified_base (155)..(155): a, c, t, g, unknown or other
  misc_feature (155)..(155): n is a, c, g, or t
  modified_base (157)..(157): a, c, t, g, unknown or other
  misc_feature (157)..(157): n is a, c, g, or t
  modified_base (159)..(161): a, c, t, g, unknown or other
  misc_feature (159)..(161): n is a, c, g, or t
  modified_base (166)..(166): a, c, t, g, unknown or other
  misc_feature (166)..(166): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagacgctcgacacacgaccggtgctcgattttagtctagcgactttccgtcgggtcgtgggcaaggccgcgactaggctgcctggtcaaggactacttcctgtccgagcgtcttcgagtcgggcttggcaaggcgcatagcagcnagagnngngngnnngcatncgtgtgtctgagcgatagcagctcgctaggtctnacagcnganacanatacaagcgnttactacntagacggtaacncgaccacgacgcgacgcgacgacgtacgctagtcttagtacggacgactacgacgtacctacgtacggaccgtacgccggtaccgtcttacgtacgtacgtccggtaaccggttacggtacgggtaacctaacgtaccgttacccgttaccgtaccgtaacgtaccgtaccgttacccggtaccggtaccggtaccgtaccgtaccgttaccgttaccggtaccggtaccggtaccggtaccggtaccgtaaccgtacgtaccgttaccgttaccgtaccgtaccgttaccgtaccgtaccgtaccgtaccgtacgtacgtacgttacgttaccgttaccgtaccggtaccgtaccgtacgttaccgttacgttacgtacgtacgtacggtaccggtaccgtaccggtaccgtaccggtaccgtaccgtacgtaccgtacgtcgtccg

SEQ ID NO: 172928 - DNA, 143 bp, Homo sapiens
  misc_feature: GYAE6OF02FHI4Z.2.13.B02.1.454.CMB.1.raw
  modified_base (127)..(143): a, c, t, g, unknown or other
  misc_feature (127)..(143): n is a, c, g, or t
tcagacgctcgacacacgaccggtgctcgatttagtctagcgacttccgcgggctggcaaggcgcatagctgcctggtcaaggactacttcctgtcgagcgtctgagcggctggcaaggcgcatagnnnnnnnnnnnnnnnnn

SEQ ID NO: 172929 - DNA, 144 bp, Homo sapiens
  misc_feature: GYAE6OF02H0CNE.2.13.B02.1.454.CMB.1.raw
  modified_base (50)..(50): a, c, t, g, unknown or other
  misc_feature (50)..(50): n is a, c, g, or t
  modified_base (128)..(144): a, c, t, g, unknown or other
  misc_feature (128)..(144): n is a, c, g, or t
tcagacgctcgacacacgaccggtgctcgatttagtctagcgacttccgngggctggcaaggcgcatagctgcctggtcaaggactacttcctgtcgagcgtctgagcgggctggcaaggcgcatagnnnnnnnnnnnnnnnnn

SEQ ID NO: 172930 - DNA, 152 bp, Homo sapiens
  misc_feature: GYAE6OF02JSICX.2.13.B02.1.454.CMB.1.raw
  modified_base (128)..(152): a, c, t, g, unknown or other
  misc_feature (128)..(152): n is a, c, g, or t
tcagacgctcgacacacgaccggtgctcgatttagtctagcgacttccgcgggctggcaaggcgcatagctgcctggtcaaggactacttcctgtcgagcgtctgagcgggctggcaaggcgcatagnnnnnnnnnnnnnnnnnnnnnnnnn

SEQ ID NO: 172931 - DNA, 771 bp, Homo sapiens
  misc_feature: GYAE6OF02GGUS3.2.13.B02.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (568)..(568): a, c, t, g, unknown or other
  misc_feature (568)..(568): n is a, c, g, or t
tcagacgctcgacacacgaccggtgctcgatttagtctagcgactttagggttagggggagaactgctctagttaggacccagacggaaccatggaagccccagacgctaggacttctcttcctcgtgactacctctggctcccagactaccacgtggagtaaactgtgacctaggaccgcgacgtctaccgagccctacccgtggtcctggtacgtcgtaaccggaaggggtaacncgccctacccgtcgtccnggaccagggaccagtcgagtagttgtacgcgacctaagttacgcgtacggtaccagacgagtacgcgtacggtaccacgtaccgaccgtggaccttacgtagccgtaggtcggtcgactaaccgtcccgaacggtcgtaaccctaggtcgtaacccgtcccgagtacctaacgggttacacgggttaccgcgttagggtacgggtgaaccgggatacgtacgtacctacgtacgtaccgcttacgacaaccgtcgactccggtatacctacggacgttaatacggttacttacgtcgtttaagtttaccgtancggttaacgtaactaacgtaacggtttaaccgaatttacccggtacgggtaccggtacgttacccgtaacgggtaacgtaaaccggtacgggtaaagttaccggaacgtaaacgtaaccgggttagtaaccggttaccggtacgtaaccgtccgttacggtacgttaccggtacccggttagttaccccaggtttaacccccg

SEQ ID NO: 172932 - DNA, 189 bp, Homo sapiens
  misc_feature: GYAE6OF01BKDDG.31.61.F06.1.454.CMB.1.raw
  modified_base (189)..(189): a, c, t, g, unknown or other
  misc_feature (189)..(189): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatagn

SEQ ID NO: 172933 - DNA, 193 bp, Homo sapiens
  misc_feature: GYAE6OF01A27W2.31.61.F06.1.454.CMB.1.raw
  modified_base (189)..(193): a, c, t, g, unknown or other
  misc_feature (189)..(193): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccctcctcacgtctactgctgagcgggctggcaaggcgcatagnnnnn

SEQ ID NO: 172934 - DNA, 189 bp, Homo sapiens
  misc_feature: GYAE6OF01DRQ19.31.61.F06.1.454.CMB.1.raw
  modified_base (189)..(189): a, c, t, g, unknown or other
  misc_feature (189)..(189): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccctcctcacgtctactgctgagcgggctggcaaggcgcatagn

SEQ ID NO: 172935 - DNA, 190 bp, Homo sapiens
  misc_feature: GYAE6OF01BFQKS.31.61.F06.1.454.CMB.1.raw
  modified_base (189)..(190): a, c, t, g, unknown or other
  misc_feature (189)..(190): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccctcctcacgtctactgctgagcgggctggcaaggcgcatagnn

SEQ ID NO: 172936 - DNA, 222 bp, Homo sapiens
  misc_feature: GYAE6OF01DT2KH.31.61.F06.1.454.CMB.1.raw
  modified_base (189)..(222): a, c, t, g, unknown or other
  misc_feature (189)..(222): n is a, c, g, or t
tcagcagtagacgtcacgaccggtgctcgatttagctacgctctaagggaaagggtgagatccctcactgtggctcactttcggcggagggccaaggtggagatcaaacgaactgtggctgcaccatctgtcttcatcttcccgccctcctcacgtctactgctgagcgggctggcaaggcgcataggnnnnnnnnnnnnnnnnnnnnnnnnnnnnnnnnnn

SEQ ID NO: 172937 - DNA, 214 bp, Homo sapiens
  misc_feature: GYAE6OF01EF89P.31.61.F06.1.454.CMB.1.raw
  modified_base (191)..(214): a, c, t, g, unknown or other
  misc_feature (191)..(214): n is a, c, g, or t
tcagcagtagacgtcacgaccggtgctcgatttagctacgctctaagggaaagggtggagatccctcactgtggctcgactttcggcggagggaccaaggtggagatcaaacgaactgtcggctgcaccatctgtcttcatcttcccacctcctcacgtctactgctgagcgggctggcaaggcgcatagnnnnnnnnnnnnnnnnnnnnnnnn

SEQ ID NO: 172938 - DNA, 193 bp, Homo sapiens
  misc_feature: GYAE6OF01B86Z9.31.61.F06.1.454.CMB.1.raw
  modified_base (189)..(193): a, c, t, g, unknown or other
  misc_feature (189)..(193): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatagnnnnn

SEQ ID NO: 172939 - DNA, 189 bp, Homo sapiens; identical to SEQ ID NO: 172932
  misc_feature: GYAE6OF01BIYP3.31.61.F06.1.454.CMB.1.raw
  modified_base (189)..(189): a, c, t, g, unknown or other
  misc_feature (189)..(189): n is a, c, g, or t

SEQ ID NO: 172940 - DNA, 191 bp, Homo sapiens
  misc_feature: GYAE6OF01BYAI1.31.61.F06.1.454.CMB.1.raw
  modified_base (189)..(191): a, c, t, g, unknown or other
  misc_feature (189)..(191): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccatctgaacgcactcgtctgagcgggctggcaaggcgcatagnnn

SEQ ID NO: 172941 - DNA, 234 bp, Homo sapiens
  misc_feature: GYAE6OF01ENGJ8.31.61.F06.1.454.CMB.1.raw
  modified_base (198)..(198): a, c, t, g, unknown or other
  misc_feature (198)..(198): n is a, c, g, or t
  modified_base (203)..(204): a, c, t, g, unknown or other
  misc_feature (203)..(204): n is a, c, g, or t
  modified_base (206)..(234): a, c, t, g, unknown or other
  misc_feature (206)..(234): n is a, c, g, or t
tcagcagtagacgtcacgaccggtgctcgatttagctacgctctaagggaaagggtgagatcccctcactgtggctcactttcggcggagggaccaaggtggagatcaaacgaactgtggctgccaccatctgtcttcattccttccccacccttcctcacgtctacgtgcgtgacggcgggcgtggacgaaggcganatagnncnnnnnnnnnnnnnnnnnnnnnnnnnnnnn

SEQ ID NO: 172942 - DNA, 197 bp, Homo sapiens
  misc_feature: GYAE6OF01BPUDR.31.61.F06.1.454.CMB.1.raw
  modified_base (175)..(175): a, c, t, g, unknown or other
  misc_feature (175)..(175): n is a, c, g, or t
  modified_base (193)..(197): a, c, t, g, unknown or other
  misc_feature (193)..(197): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatccttcccaccctcctcacgtcctactgctgacgcggntggacaaggcgacatagnnnnn

SEQ ID NO: 172943 - DNA, 188 bp, Homo sapiens
  misc_feature: GYAE6OF02HUGXO.31.61.F06.1.454.CMB.1.raw
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatag

SEQ ID NO: 172944 - DNA, 190 bp, Homo sapiens
  misc_feature: GYAE6OF02GGLK8.31.61.F06.1.454.CMB.1.raw
  modified_base (189)..(190): a, c, t, g, unknown or other
  misc_feature (189)..(190): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatagnn

SEQ ID NO: 172945 - DNA, 201 bp, Homo sapiens
  misc_feature: GYAE6OF02HAAMJ.31.61.F06.1.454.CMB.1.raw
  modified_base (187)..(201): a, c, t, g, unknown or other
  misc_feature (187)..(201): n is a, c, g, or t
tcagcagtagacgtcacgaccggtgctcgatttagctacgctctaagggaagggtgagatccctcactgtggctcactttcggcggagggccaaggtggagatcaaacgaactgtggctgcaccatctgtcttcatcttcccgccctcctcacgtctactgctgagcgggctggcaaggcgcatagnnnnnnnnnnnnnnn

SEQ ID NO: 172946 - DNA, 225 bp, Homo sapiens
  misc_feature: GYAE6OF02IGJKY.31.61.F06.1.454.CMB.1.raw
  modified_base (194)..(225): a, c, t, g, unknown or other
  misc_feature (194)..(225): n is a, c, g, or t
tcagcagtagacgtcacgaccggtgctcgatttagctacgctctaagggaaagggtgagatccctcactgtggctcgactttcggcggagggaccaaggtggagatcaaacgaactgtggcttgcaccatctgtcttcatcttcccacctcctcgacgtctactgctcgagcgggctggcaaggcggcatagtnnnnnnnnnnnnnnnnnnnnnnnnnnnnnnnn

SEQ ID NO: 172947 - DNA, 191 bp, Homo sapiens
  misc_feature: GYAE6OF02HNW32.31.61.F06.1.454.CMB.1.raw
  modified_base (189)..(191): a, c, t, g, unknown or other
  misc_feature (189)..(191): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatagnnn

SEQ ID NO: 172948 - DNA, 190 bp, Homo sapiens; identical to SEQ ID NO: 172944
  misc_feature: GYAE6OF02HYNZQ.31.61.F06.1.454.CMB.1.raw
  modified_base (189)..(190): a, c, t, g, unknown or other
  misc_feature (189)..(190): n is a, c, g, or t

SEQ ID NO: 172949 - DNA, 230 bp, Homo sapiens
  misc_feature: GYAE6OF02G29H5.31.61.F06.1.454.CMB.1.raw
  modified_base (187)..(230): a, c, t, g, unknown or other
  misc_feature (187)..(230): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgcctctcacgtctactgctgagcgggctggcaaggcgcatagnnnnnnnnnnnnnnnnnnnnnnnnnnnnnnnnnnnnnnnnnnnn

SEQ ID NO: 172950 - DNA, 195 bp, Homo sapiens
  misc_feature: GYAE6OF02G24N2.31.61.F06.1.454.CMB.1.raw
  modified_base (189)..(195): a, c, t, g, unknown or other
  misc_feature (189)..(195): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccctcctcacgtctactgctgagcgggctggcaaggcgcatagnnnnnnn

SEQ ID NO: 172951 - DNA, 199 bp, Homo sapiens
  misc_feature: GYAE6OF02FR5Q1.31.61.F06.1.454.CMB.1.raw
  modified_base (188)..(199): a, c, t, g, unknown or other
  misc_feature (188)..(199): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccgccctcctcacgtctactgctgagcggctggcaaggcgcatagnnnnnnnnnnnn

SEQ ID NO: 172952 - DNA, 204 bp, Homo sapiens
  misc_feature: GYAE6OF02HUKK6.31.61.F06.1.454.CMB.1.raw
  modified_base (189)..(191): a, c, t, g, unknown or other
  misc_feature (189)..(191): n is a, c, g, or t
  modified_base (193)..(204): a, c, t, g, unknown or other
  misc_feature (193)..(204): n is a, c, g, or t
tcagcagtagacgtcacgaccggtgctcgatttagctacgctctaagggaaagggtgagatccctcactgtggctcactttcggcggagggaccaaggtggagatcaaacgaactgtggctgcaccatctgtcttcatcttcccaccctcctcacgtctactgctgagcgggctggcaaggcgcatagnnngnnnnnnnnnnnn

SEQ ID NO: 172953 - DNA, 191 bp, Homo sapiens; identical to SEQ ID NO: 172947
  misc_feature: GYAE6OF02GAJ2Q.31.61.F06.1.454.CMB.1.raw
  modified_base (189)..(191): a, c, t, g, unknown or other
  misc_feature (189)..(191): n is a, c, g, or t

SEQ ID NO: 172954 - DNA, 190 bp, Homo sapiens; identical to SEQ ID NO: 172935
  misc_feature: GYAE6OF02GSRAJ.31.61.F06.1.454.CMB.1.raw
  modified_base (189)..(190): a, c, t, g, unknown or other
  misc_feature (189)..(190): n is a, c, g, or t

SEQ ID NO: 172955 - DNA, 170 bp, Homo sapiens
  misc_feature: GYAE6OF01BT9P4.22.78.H01.1.454.CMB.1.raw
  modified_base (170)..(170): a, c, t, g, unknown or other
  misc_feature (170)..(170): n is a, c, g, or t
tcagacatacgcgtcacgaccggtgctcgatttagtgtgagtagtttgggtttgggaagaggaagactgacggtccccaggagttcaggtgctgggcacagcggccctgggctgcctggtcaaggactaattccacgcgtatgtctgagcgggctggcaaggcgcatagn

SEQ ID NO: 172956 - DNA, 530 bp, Homo sapiens
  misc_feature: GYAE6OF01B05CW.22.78.H01.1.454.CMB.1.raw
  modified_base (296)..(296): a, c, t, g, unknown or other
  misc_feature (296)..(296): n is a, c, g, or t
  modified_base (525)..(530): a, c, t, g, unknown or other
  misc_feature (525)..(530): n is a, c, g, or t
tcagacatacgcgtcacgaccggtgctcgatttagtgtgagtagtttgggtttgggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttcngtgtcaaagccagcgggcgatctacgatcctaacggctattactacggatttgacacctggggccaggggaaccctggtcaccgtctcctcagcctccaccaagggcccatcggtcttcccctggccacccctcctccaagagcacctctggggcacagcggccctgggctgcctggtcaaggacctacttccacgcgtactgtctgagcgggctggcaggcgcatagnnnnnn

SEQ ID NO: 172957 - DNA, 174 bp, Homo sapiens
  misc_feature: GYAE6OF01BQ7VX.22.78.H01.1.454.CMB.1.raw
  modified_base (173)..(174): a, c, t, g, unknown or other
  misc_feature (173)..(174): n is a, c, g, or t
tcagacatacgcgtcacgaccggtgctcgatttagtgtgagtagtttgggtttgggggaagaggaagactgacggtcccccaggagttcaggtgctgggcacagcggccctgggctgcctggtcaaggactacttccacgcgtatgtctgagcgggctggcaaggcgcatagnn

SEQ ID NO: 172958 - DNA, 553 bp, Homo sapiens
  misc_feature: GYAE6OF01C8KJJ.22.78.H01.1.454.CMB.1.raw
  modified_base (542)..(542): a, c, t, g, unknown or other
  misc_feature (542)..(542): n is a, c, g, or t
  modified_base (548)..(553): a, c, t, g, unknown or other
  misc_feature (548)..(553): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcacgcctccaccaagggcccatccggtcttccccctcggccacccctccctcccaacgacgccaccctccgtgggggccacgacgccggcccgtcgggctgccgtggtcaaggctacttccacgcgtatgtctgagcgggctggcgaggccgnatacgnnnnnn

SEQ ID NO: 172959 - DNA, 632 bp, Homo sapiens
  misc_feature: GYAE6OF01BWJFZ.22.78.H01.1.454.CMB.1.raw
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatccggtccttccccctcggccacccctccctcccaacgacgccaccctcgtcgggggccaccgacggccggcccgtcggggcctcggcccgttcgggtaccgaaacggggtacccttaaccgtttcccgaaccggtccggttaacgttcggttccgttcggaacgggccgggggtccgttggggaccgtaaacggggccggaccgaagttaacggnancgngnn

SEQ ID NO: 172960 - DNA, 603 bp, Homo sapiens
  misc_feature: GYAE6OF01C3R9X.22.78.H01.1.454.CMB.1.raw
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaaggactggagtggtcgcgaccatcactggaactggaattagtacttactacgcagagtccgtgaagggacgttcaccatcncagagacaactccgaggaccacttgtttattagacatgaaagngcctgcgcactgcggacacggccgtctatttcngtgtacaaagccagcggcgactcacgatccgtaaggcttaattaacacggtatttagacctacgtggggaccaaggggaaccctgggtccaccgttctacgtcaacgccctaccgaaccgaagggcccagttccggtccttccccgtcggtccaccccgtccctacccaacgacgactaccgtcgtacggggacacgacgccggcccgtgggcctcgccgtacggtcgaacggtactaccgttacaccgacgtacgtacgtcgtggacgccggtcgtggcgaaggccgacgaagtcganagcngngn

SEQ ID NO: 172961 - DNA, 587 bp, Homo sapiens
  misc_feature: GYAE6OF01BT1OP.22.78.H01.1.454.CMB.1.raw
  modified_base (582)..(584): a, c, t, g, unknown or other
  misc_feature (582)..(584): n is a, c, g, or t
  modified_base (586)..(587): a, c, t, g, unknown or other
  misc_feature (586)..(587): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacgttcaccatctccagagacaactcccaggacacttgtttatttagacatgaagagcctgcgcactgcggacacggccgtctatttctgtgtcaaagccagcgggcgatctacgatcctaacggctattactacggatttgacactggggccagggaaccctggtcacgtctcctcacgccctccaccgaacgggcccacgtccggttccttccccccgtcggcctaccccgtcccttacccgaaacgacgccacctccgtggggccacgacgccggcccgtgggccgtgccgtcggtacgaaggaccttacttccaccgcgtatgtccgtggacggcgggcgttgggcgaaacgggcgaccgaagtacgannngnn

SEQ ID NO: 172962 - DNA, 555 bp, Homo sapiens
  misc_feature: GYAE6OF01B7UED.22.78.H01.1.454.CMB.1.raw
  modified_base (550)..(555): a, c, t, g, unknown or other
  misc_feature (550)..(555): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctaattactacggatttgacacgtggggccagggaaccctggtcaccgtctcctcacgccctccaccaaacgggcccagtccggtccttcccccgtcggccacccctcctcccaacgacgccacctcgtcggggcacgacgccggcccgtgggctcgcctggtcaacggtactacttccacgcgtatgtctgagcgggctggcaaggcgcatgnnnnnn

SEQ ID NO: 172963 - DNA, 533 bp, Homo sapiens
  misc_feature: GYAE6OF01C1P49.22.78.H01.1.454.CMB.1.raw
  modified_base (528)..(533): a, c, t, g, unknown or other
  misc_feature (528)..(533): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaaggctattactacggatttgacactggggccagggaaccctggtcaccgtctcctcagcctccaccaagggcccatcggtcttccccctggccacccctcctccaagagccacctctgggggcacgagccggccctgggctgcctggtcaaggctactccacgcgtatgtctgagcgggctggcaaggcgcatagnnnnnn

SEQ ID NO: 172964 - DNA, 573 bp, Homo sapiens
  misc_feature: GYAE6OF01CYSUO.22.78.H01.1.454.CMB.1.raw
  modified_base (426)..(426): a, c, t, g, unknown or other
  misc_feature (426)..(426): n is a, c, g, or t
  modified_base (568)..(573): a, c, t, g, unknown or other
  misc_feature (568)..(573): n is a, c, g, or t
tcagacatacgcgtcacgaccggtgctcgatttagtgtgagtagtttgggtttggggggggtcctcgagactctcctgtagaggctctggattcaccttttaagtcttatgccatgacctggatccgccagactccgggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccaggcggcggatctacgatcctaacggctatttactacggtatttgacaccgtggggccagggaaccctggtcaccgtctcctcacgcctccacaaggcccagtccgtcttccccngccaccctcctccaacgacgccacctcgtcggggccacgacgccggccctgggcctcgcccgtggtaccgaacggtacctaccttccgaccgcgtaacttggtctggacggccgggcgtgggcgaacgggcgacgagtacgnnnnnn

SEQ ID NO: 172965 - DNA, 588 bp, Homo sapiens
  misc_feature: GYAE6OF01D78B1.22.78.H01.1.454.CMB.1.raw
  modified_base (584)..(588): a, c, t, g, unknown or other
  misc_feature (584)..(588): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccaggggaaccctggtcaccgtctcctcacgcctccaccaagggcccatcgtccttcccctcggccaccctccctccaacgacgcaccctcgtggggccacgacgccgggcccgtcgggccgtcggcccgtcgggtaccgaacgggtaccttaccttcccgaccggtaccgttattcggttcgtggacggtccggggcgtgggcgaacgggccgcagtacgcnnnnn

SEQ ID NO: 172966 - DNA, 600 bp, Homo sapiens
  misc_feature: GYAE6OF01A51JY.22.78.H01.1.454.CMB.1.raw
  modified_base (260)..(260): a, c, t, g, unknown or other
  misc_feature (260)..(260): n is a, c, g, or t
  modified_base (590)..(590): a, c, t, g, unknown or other
  misc_feature (590)..(590): n is a, c, g, or t
  modified_base (597)..(597): a, c, t, g, unknown or other
  misc_feature (597)..(597): n is a, c, g, or t
tcagacatacgcgtcacgaccggtgctcgatttagtgtgagtagtttgggtttgggggggtcctcgagactctcctgtagaggctctggattcacctttaagttcttatgccatgacctggatccgccagactccggggaaggactggagtgggtcgcgaccatcactggaactggaattagtacttactacgcagagtccgtgaagggacgttcaccatctcagagacaactccagacactgtttattagacatgaagngcctgcgcactgcgacacggccgtctatttctgtgtcaaagccagcgggcgatctacgatccgtaacggctattactacggatttagacaccgtggggaccagggaaccctggtcaccgtctcctcacgccctccaccgaacgggcccagtccggtccttacccctggccaccctacctccaacgacgcaccctcgtcggggccacgacgccggcccgtagggcctcggccgtcgggtaccgaacgggtaccttaccttcccgacggtcgttacgtacggttctaggacggtccggggccttggaccgtaacgggacgacgacgtagganagtgagngtg

SEQ ID NO: 172967 - DNA, 652 bp, Homo sapiens
  misc_feature: GYAE6OF01D31NM.22.78.H01.1.454.CMB.1.raw
  modified_base (645)..(648): a, c, t, g, unknown or other
  misc_feature (645)..(648): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacggttcaccatctccagagacaactcccaggacacttgtttattagacatgaagagcctgcgcactgcggacacggccgtctattctgtgtcaaagccagcgggcggatctacgactccgtaacggcttaattactacggtattttacgactaccgtggggaccaacggggaaccctggtaccaccggtctccctcgacgccctccgaaccgacgggcccagttccggtcccttcccccgtcggccctacccctccctaccaacgacgaccacccgttccgtcgggggaccacgtacggcccgggtcccgtcgggccgtcggccgtcggtaccgtaaacggtacccttaacccgttcccgaccggtccgttaacgtcggttccgttacggacgggtccgggtaccgtcgggacgacgggccgacgaagtacgnnnngngn

SEQ ID NO: 172968 - DNA, 579 bp, Homo sapiens
  misc_feature: GYAE6OF01BA76B.22.78.H01.1.454.CMB.1.raw
  modified_base (574)..(579): a, c, t, g, unknown or other
  misc_feature (574)..(579): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggcggttcaccatctccagagacaactcccaggacactgtttattagacatgaagagcctgcgcactgcggacacggccgtctatttctgtgtcaaagccagcgggcggatctacgatcctaacggctattactacggattttgacaccgtggggccaggggaaccctggtcaccgtctcctcagcctccaccaagggcccatccggtccttccccctcggccacccctccctcccaacgacgccacccgtcgtcgggggccaccgacggccgggccccgtcggggcctcgcccgtcgggtcgaaacggtaccttaccttccacgccgtagtcgtctgaggcgggcgtggcgagggcgcagtagnnnnnn

SEQ ID NO: 172969 - DNA, 610 bp, Homo sapiens
  misc_feature: GYAE6OF01EX6K9.22.78.H01.1.454.CMB.1.raw
  modified_base (266)..(266): a, c, t, g, unknown or other
  misc_feature (266)..(266): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatcccgccagactccggggaagggactggagtgggtcgcgaccatcactggaactggaattagtacttactacgcagagtccgtgaagggacgttcaccatctccagagacaactcccaggacacttgttttattagacatgaagngcctgcgcactgcggacacggccgtctatttctgtgtcaaagccaggcgggcggatctacgatccgtaacggcttattactaggatttgacaccgtggggccagggaaccctggtcaccgtctcctcacgccctccaccgacgggcccagtccgtccttccccgtcgccaccctcctccaacgacgccacctcgtcggggccacgacggccggcccgtcgggctcggccgtcggtaccgaacggtaccttaccgttcccgacggtaccgttacttcggttccgttcggacgggtccggggtccgtacgggaccggaacgggccggacgacgtacggnanngngn

SEQ ID NO: 172970 - DNA, 603 bp, Homo sapiens
  misc_feature: GYAE6OF01CVWX4.22.78.H01.1.454.CMB.1.raw
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
  modified_base (598)..(599): a, c, t, g, unknown or other
  misc_feature (598)..(599): n is a, c, g, or t
  modified_base (601)..(603): a, c, t, g, unknown or other
  misc_feature (601)..(603): n is a, c, g, or t
tcagacatacgcgtcacgaccggtgctcgatttagtgtgagtagttttgggtttgggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggcggttcaccatctcagagacaactcccaggacacttgtttatttagacatgaagagctgcgcactgcggacaccggccgtctatttctgtgtcaaagccaggcggcggatctacgataccgtaacggcttaattacgtacgtatttcgaccncgtcggggccgacgggaaccctggtccaccgtcctccncacgccctaccaccgaacggcccacgttccggtccttcccctcggtccacccctccctccaacgacgcctacctcgtcggggcaccgacgccgggcccgtcgggcctcggtccgtcggtaccgaacggtaccttaccgttcccgacgcgttatcgtcgtggaggcgggtcgtcgggacgacgggcgacagtagcnncnnn

SEQ ID NO: 172971 - DNA, 652 bp, Homo sapiens
  misc_feature: GYAE6OF01DCGIX.22.78.H01.1.454.CMB.1.raw
  modified_base (649)..(651): a, c, t, g, unknown or other
  misc_feature (649)..(651): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcacatctccagagacaactcccaggacacttgtttatttagacatgaagagcctgcgcactgcggacacggccgtctatttctgtgtacaaagccaggcgggcggatctacgactcctaacggcttacttactacggtattttcgacctaccgtcggggccacggggaaccctggtaccaccgtctcctcacgccctcccaaccgacgggccctacgtccggtccttcccccgtcggccctaccctccctacccgaacgacgccacccgttccggtcgggggtccacgacgggcccgtcccggtcgggccgtcggcccgttcgggtaccgaacggtaccgttaccgttcccgtaaccggtccgttacgttcggttccgtcgggacggccggggtacgtgggacgaacggggccgtacgaacgtacggcagcgnnng

SEQ ID NO: 172972 - DNA, 670 bp, Homo sapiens
  misc_feature: GYAE6OF01AK988.22.78.H01.1.454.CMB.1.raw
  modified_base (266)..(266): a, c, t, g, unknown or other
  misc_feature (266)..(266): n is a, c, g, or t
  modified_base (347)..(347): a, c, t, g, unknown or other
  misc_feature (347)..(347): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
tcagacatacgcgtcacgaccggtgctcgatttagtgtgagtagtttgggtttgggggggtccgtcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacacttgtttattagacatgaagngcctgcgcactgcggacacggccgtcttattctgtgtacaaagccaggcgggcgatcacgactcgaacggctattacaggntttacgacaccgtggggacccaaggggaacccctgggtaccaccggtcctaccaccgacgccctacccaacgaaccgggtccccaagttcccggtcccgttcccccgtaccggtacccgtacccccgttccctaccccgtaacgaccgacccaccgtccggtacgggggacctaccgacggccccgggtcccgtcgggtccgtcgtccgttacggtaccgtaacggtacctaccgttccgtaaccggtccgttacgtcgttcgtcggacgggtaccgggtcgtcggacggtacggacggacgtacgtacgcgtcgngcgngng

SEQ ID NO: 172973 - DNA, 617 bp, Homo sapiens
  misc_feature: GYAE6OF01EE0YB.22.78.H01.1.454.CMB.1.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (613)..(617): a, c, t, g, unknown or other
  misc_feature (613)..(617): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatcccgccagactccgggggaaggactggagtgggtcgcgaccatcactggaactggaattagtacttactacgcagagtccgtgaagggacgttcaccatctccaganacaactcccagacactgtttattagacatgaagagcctgcgcactgcgacacggccgtcttatttctgtntacaaagccaggcgggcggatctacgatacctaacggtcttaattactacggtatttcgacaccgtggggacccaaggggaaccctggtaccaccgttctacctcacgccctacccgaaccgaagggcccctagtccgttcccttcccccgtcggcccaccctccctaccctaacgacgccacccgtccgtcggggaccacgacggcccggcccgtcgggtccgtcgccgtcggtacaacggtaccttaccgttccaccggtcgtatcgtctcggacggcgggtcgtggacgtaacgggccgagtacgtagcnnnnn

SEQ ID NO: 172974 - DNA, 644 bp, Homo sapiens
  misc_feature: GYAE6OF01DL0A7.22.78.H01.1.454.CMB.1.raw
  modified_base (630)..(630): a, c, t, g, unknown or other
  misc_feature (630)..(630): n is a, c, g, or t
  modified_base (637)..(638): a, c, t, g, unknown or other
  misc_feature (637)..(638): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggctggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccaggcgggcgatctacgactcctaacggctattactaacggtatttgactaccgtggggccaaggggaacccctggtccaccgttcctcctcacgccctacccgaacccgaaacgggcccctaagtcccggttccctttaccccccctcgggtcccctaacccccttcccctaccccgaacgaacgtaccacccgttccggtcgggggtcccaaccgacggcccgggcccgttcggggccgttcggcccgttcggtaccgaacggtacctaccttcccgacgtcgttactcggtcgtgacggcgggctggacgaacggccganacgtagnncngnng

SEQ ID NO: 172975 - DNA, 660 bp, Homo sapiens
  misc_feature: GYAE6OF01CXG3K.22.78.H01.1.454.CMB.1.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (620)..(620): a, c, t, g, unknown or other
  misc_feature (620)..(620): n is a, c, g, or t
  modified_base (656)..(660): a, c, t, g, unknown or other
  misc_feature (656)..(660): n is a, c, g, or t
tcagacatacgcgtcacgaccggtgctcgatttagtgtgagtagtttggggtttggggggggtcctcgagactctcctgtagaggctctggattcacctttaagtcttatgccatgacctggactccgccagacgtccgggggaaggactggagtgggtcgcgaccatcactggaactggaattagtacttacacgcagagtccgtgaagggtacgttcaccatcncagagacaactccaggacacttagtttattagacatgaagngctgcgcactgcggacacggcttctattctgtgtacaaacgccgaggcgggacgatcgtacgactaccgtacggtacttagttacacggtatttagacctaccggtacggggaccgaacgggtaaccctgggtcctaccggttcctccgtacgaccgtccctacccgaaaccggtacgggcccctaggttcccgtccccttccccgtcggtaccctacccctcccgtaccaacggaccgccgtaacccgtccgggtcggggaccctaccggacggtcccgggtcccggtggggtccctcggtccgtacggtaaccgaacgtacccttcgtacccgacgtcgttacgtcgtcgnggacggtcggcgtacgggacgaaggcgacagtagcnnnnn

SEQ ID NO: 172976 - DNA, 618 bp, Homo sapiens
  misc_feature: GYAE6OF01CBN94.22.78.H01.1.454.CMB.1.raw
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggacggttcaccatctccagagacaactcccaggacacttgtttattagacatgaagagcctgcgcactgcggacacggccgtctatttctgtgtcaaagccaggcgggcgatctacgatcctaacggctattactacggtatttgactaccgtggggccaggggaaccctggtaccaccgtctcctcacgccctaccaaccgacgggccccagttccggtccttcccccgtcggccacccctccctacccgaacgacgccaccctcgtcggggacacgacggccggcccgtcgggcctcggccgtcggtacgaacggtaccttaccgttacccacggtcgttacgtcgttccgtggtacggccggggtcgtcgggaccgaacgggccgacgaacgtacgacngangngcg

SEQ ID NO: 172977 - DNA, 652 bp, Homo sapiens
  misc_feature: GYAE6OF01EQ2SC.22.78.H01.1.454.CMB.1.raw
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(652): a, c, t, g, unknown or other
  misc_feature (651)..(652): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatcccgccagactccgggggaagggactggagtgggtcgcgaccatcactggaactggaattagtacttactacgcagagtccgtgaagggcggttcaccatctccagagacaactcccatgacacttgttttatttagacatgaaagagcctgcgcactgcggacacggccgtctatttctgtgtacaaagccaggcgggcggatcgtacgatccgtaacggctaattacgtacggtattttcgacctaccgtggggaccaacgggaacccgtggtaccacccgtcctccctacgacgccctccgaccgaacgggccctagttccggtccctttcccccgtcggcccacccctccctaccgaagacgccacccgtcggtcggggccaccgacggccgggtcccgtgggccttcggccgttcggtaccgaacggtaccttaccgttcccgaccgtacgttacgttcggttacgtacgggacggtcggggtcggtacgggacggaacggccgacgtaagtacggnacngnn

SEQ ID NO: 172978 - DNA, 832 bp, Homo sapiens
  misc_feature: GYAE6OF01A5NLN.22.78.H01.1.454.CMB.1.raw
  modified_base (297)..(297): a, c, t, g, unknown or other
  misc_feature (297)..(297): n is a, c, g, or t
  modified_base (378)..(378): a, c, t, g, unknown or other
  misc_feature (378)..(378): n is a, c, g, or t
  modified_base (827)..(827): a, c, t, g, unknown or other
  misc_feature (827)..(827): n is a, c, g, or t
  modified_base (829)..(829): a, c, t, g, unknown or other
  misc_feature (829)..(829): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagacgtccgggggaaggactggagtgggtcgcgaccatcactggaactggaattagtacttactacgcagagtccgtggaagggtacggttcaccatctccagacgaccaactcccaggacacttgtttattagacatgaagagcctgcgcactgcggacacggccttnttatttcgtgtcgtacaaacgccgagggccggggacgtactccgtacgactcccgtaacggctttaagttacgtacggttnttacgacgtccggtggggacccaacggggtaaccctgggtacccacccggttccttacccgtcgacccgtacccctacccaaaccggaaaccgggtcccctaggtttcccccgggttcccctttccccccggtaccggtaccccctacccccgttacccgtaaccccgaaacggtacccggtaccctaaccccggttccgggttaccggggggacccaaacccggtacccgggtccccgggtacccccgggttaccggggccgtttcccgggtacccggttaccggggttaaccgtaaacccgggttaacccgttaacccgtttaccccggaacccggtttccggttaacggttccgggttaccggttaccggggtaaccgggtcccgggggttcggtaccggggtaaccggtaacgggtacccgtacggtaacgtaacgcgtaagcgngngcg

SEQ ID NO: 172979 - DNA, 671 bp, Homo sapiens
  misc_feature: GYAE6OF01B2H6H.22.78.H01.1.454.CMB.1.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggacgttcaccatctccagagacaactcccaggacactgtttattagacatgaagngctgcgcacgtgcggacacggccgtctatttcngtcgtacaaagccaggcgggcgatcgtacgataccgtaaggtctaattaccgtacggtaattcggaacctaccgtcgggggacctaacggggaaccccgttggtaccctacccggttctcccgtaccgacgtcccctacccgaacccgaaacgggtcccctagttacccggtccctttacccccggccggtaccctaccccttacccgtacccgaacgtacgaccgtacccgttcgtccggggtacaccgacggcccggtcccgtcgggtccgtcgtcccgtggtaacgtaaccggtacgttaccttcccgacgtccgttacgtcgtcgtcgacggtccggcgtcgggacgaggccgtanacgtcgnantcgntcg

SEQ ID NO: 172980 - DNA, 710 bp, Homo sapiens
  misc_feature: GYAE6OF01CRJPG.22.78.H01.1.454.CMB.1.raw
  modified_base (305)..(305): a, c, t, g, unknown or other
  misc_feature (305)..(305): n is a, c, g, or t
  modified_base (706)..(708): a, c, t, g, unknown or other
  misc_feature (706)..(708): n is a, c, g, or t
  modified_base (710)..(710): a, c, t, g, unknown or other
  misc_feature (710)..(710): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatcccgccagactccgggggaagggactggagtgggtcgcgaccatcactggaactggaattagtactactacgcagagtccgtgaagggcggttcaccatctccagagaccaactcccaaggacacttgtttatttagacatgaagagcctgcgcactggcggacacggtccgtcttatttcngtcgtacaaacgccgaggcgggcgagtcctacgactaccgtaacgcttaattacgtacggtatttacgacctaccgtcggggaccgaacggggtaacccctggtaccctacccgttcctacccgtccgtaaccgccccgttacccaacccggaacgggtccccctacggttccccggttcccctttccccccgtcggtaccccttaccccctacccgtaccccgaaacggaccgcctacccgtcgggtacggggcccaaccgaccggcccggtcccgttcgggccgttacggtccgttacggtaccgaacgggtaccttacccttacccgtacggtacgttacgtcgtaccggcggtacgggccgggtcgtacggaccgaacgggccgactaacgtcgcannngn

SEQ ID NO: 172981 - DNA, 812 bp, Homo sapiens
  misc_feature: GYAE6OF01BKYM4.22.78.H01.1.454.CMB.1.raw
  modified_base (294)..(294): a, c, t, g, unknown or other
  misc_feature (294)..(294): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaaggactggagtgggtcgcgaccatcactggaactcccggaattagtacttactacgcagagtccgtggaagggacggttcacatctccagagacaactccagacatgtttattagacagtgaagacgcctgccgcactgcggacacggccgttntactttcgtgtcggtacaaacgtccgaaggccggggacggtaacgtccgtaacgaacttacccgtaacgggtaccttaacgtttaaccgttaacgggtatttttaccggaaccgacccgttggggggtacccaacggggtaaccccttggggtacccgtaccgtaccgttccgtcaacggtccctacccgaccgtaaacgggcccctaacgttcccgggtttcccttacccccgtcgggacccctaaccccgttcccgtaacccgaaacggtaaccgtccgtaacccgttccgggtacgggggaccctaaacccggtaccgggtcccgggaccccggttacggggcccttcggaccccggtttaggggtaacccgtaaacgggtaacccctttaccgggttcccctaacgggtaccgttaagtttcccggtagttaccgggtaaccgggtccgggaccgttacggggaacccggtaagggtcccggaagttaacgttacggctaagccgagtcgtacg

SEQ ID NO: 172982 - DNA, 894 bp, Homo sapiens
  misc_feature: GYAE6OF01BZOSZ.22.78.H01.1.454.CMB.1.raw
  modified_base (888)..(888): a, c, t, g, unknown or other
  misc_feature (888)..(888): n is a, c, g, or t
  modified_base (890)..(890): a, c, t, g, unknown or other
  misc_feature (890)..(890): n is a, c, g, or t
tcagacatacgcgtcacgaccggtgctcgatttagtgtgagtagtttgggtttggggggggtcctcgagactctcctgtagaggctctggattcacctttaagtcttatgccatgacctggactcccgccagacgtccgggggaaggactggagtgggtcgcgacctatcactggaactggaattagtacttactacgcagacgtccgtggaacgggtacgttccaccgtatcctccgaagaacgaccaaccttcccgaaggaacctaacgtttgtttttaacgtttaacgaactaagttaggaaagtacgcccttaggccgcaacgttcggaccggaccaccgggttcccgttactttacgttttcgtaggttaccgtaaccgaaaacggtccccgaagggggttcccgggggaccgttaactacccggttaaaccggtaaccgtttacccggttaaaaccggtcctttaaacgttttaacggtaaccggtttagttacggaacccgtaccgggttcgggggaccccgaaacggggtaccccgtgggttacccaacccggtttcccctaaccgtacgacccggtacccccttaccggaaaacccgtaccggggccccttacggttcccggttccccgttaccccgtcggtaccccttaccccccgtcctacccgaaagtccgtacccgtaccggtccgggtacgggacctacccgaccggcccgggcccgttacgggccggtcgtaccccggttaggaaccccgtaacgggttacccgttaccttaacccggtaccggttaccgttacggtccggttccgacggggtaccgggcccgggtggtaccgggtacggacccgggtactaaccggaggtaacgcgcacggngngtcg

SEQ ID NO: 172983 - DNA, 627 bp, Homo sapiens
  misc_feature: GYAE6OF01DZLQB.22.78.H01.1.454.CMB.1.raw
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
  modified_base (620)..(620): a, c, t, g, unknown or other
  misc_feature (620)..(620): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatcccgccagactccgggggaaggactggagtgggtcgcgaccatcactggaactggaattagtacttactacgcagagtccgtgaagggacgttcaccatctccagagacaactcccaggactactgtttattagacatgaagagcctgcnactgcggacacggccttntatttctgtgtacaaacgccaggcggggacgtatcgtacgataccgtaacggcttaattaccgtacggtatttacgacgcgtgggggcccaacggggtaaccctggtaccaccggtcctccctcgacgcccctaccaaccgaacggtcccctagttccgtcccttccccgtcgcctaccctcctaccaagcnccgtacctcgggngggaccncgacggccgccgtgggctcgcgtcggtacacggtacctaccgttaccacggtacgttacgtcgtcgtgaccgggccgggtacgttgggacggaaccgggtccgagaaccgtagacgncgngngn

SEQ ID NO: 172984 - DNA, 714 bp, Homo sapiens
  misc_feature: GYAE6OF01CAQPC.22.78.H01.1.454.CMB.1.raw
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (679)..(679): a, c, t, g, unknown or other
  misc_feature (679)..(679): n is a, c, g, or t
  modified_base (709)..(714): a, c, t, g, unknown or other
  misc_feature (709)..(714): n is a, c, g, or t
tcagacatacgcgtcacgaccggtgctcgatttagtgtgagtagtttggggtttgggggggggtcctcgagactctcctgtagaggctctggattcacctttaagtcttatgccatgacctggatccgccagacgtccggggggaagggactgggaggtggggtcgccgaccatcactggaactggaattagtacttactacgcagagtccgtggaagggtacgttcaccatctaccaganacactccagactacttgtttattagactagtagaagcgcctggcncacgtcggaccgggacaccggtccgttacttattttcgtgttacgtaccaaaacgccgagggcggggacgtatacgtaccgaacttacccggtaaacggtcttaacgttaaccgtaacggttagtttcggaacccgtaccgggtacggggggacccgtaaaccgggggtaaccccttgggtaccccctaccggtttccctcccgtaccaccggtacccctacccgaaacccggaccgggtcccctaccgtttcccggttccccttcccccgtccggcccctaccccttccctaacccgaacgtacgccctaccgtcgggtcgggccacgcggccggccgtggcctcgcgtacggacgaacgtcctaccgtccgacgtcgtagtcgtcgtcggnggcggtcgtagggaccgacggcagagtcgnnnnnn

SEQ ID NO: 172985 - DNA, 690 bp, Homo sapiens
  misc_feature: GYAE6OF01COBOA.22.78.H01.1.454.CMB.1.raw
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (291)..(292): a, c, t, g, unknown or other
  misc_feature (291)..(292): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (415)..(415): a, c, t, g, unknown or other
  misc_feature (415)..(415): n is a, c, g, or t
  modified_base (639)..(639): a, c, t, g, unknown or other
  misc_feature (639)..(639): n is a, c, g, or t
  modified_base (662)..(662): a, c, t, g, unknown or other
  misc_feature (662)..(662): n is a, c, g, or t
  modified_base (681)..(681): a, c, t, g, unknown or other
  misc_feature (681)..(681): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (690)..(690): a, c, t, g, unknown or other
  misc_feature (690)..(690): n is a, c, g, or t
tcagacatacgcgtcacgaccggtgctcgatttagtgtgagtagtttgggtttgggggggtccgtcgagactctcctgtagagctcgtggacttccaacctttaagtcttactgccatgaccttggactccgaccagacgtaccggggaaggacgtggaggtcgggtccgacgaccctatccacgtcggaactaggtaattacgtacttacacgcaggtacgtccggtagaaacgggtcgttcaacctntcgccagagaccacnccgagtacncgttattatagnatgaannctgcncgtancgacgacacgtctactaattcaggtnaaccgaaagcccgtagggacggtgacttcgaaccgtactacccggtaagtacgttactttaacccgagggttattaccggtaacccncgggttaccgggaacaaacgggtaccccgtttgaaacctcccgtcttccgaccgaccttccggaaccccaaaaggccggactcgttccccggttccctacccggacgacccctaccgtacgaacgacggacgtacccaagtttccggggcgggaacaaccggtccgtccggaaccgtgacccgtagcctaagggtacaacggttacctaacgtcgaacggtacngtcgttagacgttgaccggcganaacggagccgacctaaggngctncngcn

SEQ ID NO: 172986 - DNA, 710 bp, Homo sapiens
  misc_feature: GYAE6OF01AG0JR.22.78.H01.1.454.CMB.1.raw
  modified_base (286)..(286): a, c, t, g, unknown or other
  misc_feature (286)..(286): n is a, c, g, or t
  modified_base (704)..(704): a, c, t, g, unknown or other
  misc_feature (704)..(704): n is a, c, g, or t
  modified_base (707)..(710): a, c, t, g, unknown or other
  misc_feature (707)..(710): n is a, c, g, or t
tcagacatacgcgtcacgaccggtgctcgatttagtgtgagtagtttgggtttggggggggtcctcgagactctcctgtagaggctctggattcaccttttaagtcttatgccatgacctggatccgccagacgtccgggggaaagggactgggaggtgggtcgcgaccatcactgggaactggaaatttacgtactttactacgcagagtccgtggaaagggccggttcaccatctccagaagaccaacctcccaggacctacttgttttattagacagtgaagngcctgccgcactgccggacaccggcgttcttatttcgtgtcgtacaaagcccagggccggggcgaactccgtaaccgctaccgtaacggtcttaacgttactacggtatttcgactaccgtcgggggaccacggggaaccctcggtacctaccgttccctcccgtacaccgcccctacccgaaacccggtaccgggcccctaacgttcccggttcccctttcccccgtccggtcccctacccccgttccctacccaaccggtacgcccctacccggttccgggtccggggccaaccgggcggcccgggtcccggtgggtccgtcggtccgtcgggtacgaacggttaaccttacccgtccgtaccgtcggttactcggtcgtcggacggcccgggtgtcgggaacgcggcgcagtcgncgnnnn

SEQ ID NO: 172987 - DNA, 669 bp, Homo sapiens
  misc_feature: GYAE6OF01A5Y5S.22.78.H01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (656)..(656): a, c, t, g, unknown or other
  misc_feature (656)..(656): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
tcagacatacgcgtcacgaccggtgctcgatttagtgtgagtagtttgggtttggggggggtcctcgagactctcctgtagaggctctggattcaccttttaagtcttatgccatgacctggatccgccagactccggggaagggactggagtgggtcgcgacccatcactggaactggaattagtacttactacgcagagtccgtgaagggacgttcaccatctccagagacaactcccaggacacttgtttatttagacatgaagagcctgcgcactgcgacncggccgtctatttctgtntcaagccaggcggngntctacgatcctaacggcttacttactacggtatttggacaccggtcggggccacggggaacccctggtccacccgtctcctcacgccctaccgacccaacgggccccacgtccggtcccttcccccgtcggccctacccctccctacccaacgacgccaccctccgtcgggggtccaccgtaccggccgggtccccgtcgggccgttcggtcccgtacgggttaccgaaacggttaccgtaaccgtttaccggtacggttacgtggttccgttgggaccgggtccgggaccggttaccggggaccggtaacggggcccggaccgtaagttaacgggngacgagngngngn

SEQ ID NO: 172988 - DNA, 686 bp, Homo sapiens
  misc_feature: GYAE6OF01CQOIR.22.78.H01.1.454.CMB.1.raw
  modified_base (160)..(160): a, c, t, g, unknown or other
  misc_feature (160)..(160): n is a, c, g, or t
  modified_base (330)..(330): a, c, t, g, unknown or other
  misc_feature (330)..(330): n is a, c, g, or t
  modified_base (461)..(461): a, c, t, g, unknown or other
  misc_feature (461)..(461): n is a, c, g, or t
  modified_base (672)..(672): a, c, t, g, unknown or other
  misc_feature (672)..(672): n is a, c, g, or t
tcagacatacgcgtcacgaccggtgctcgatttagtgtgagtagtttgggtttggggggggtcctcgagactctcctgtagaggctctggattcaccttttaagtcttatgccatgacctggatcccgccagacgtccgggggaaggctggagtgggtcncgaccatcactggaactggaattagtacttactacgcagtagtccgtgaagggtcgttcactatcctcgagacgaccactcccaggactacgttgtttacttagactatagaagcgccgtgccgtcaacgtcggccggaccgtaccggtccgttcttagttttcgagttntaccgaaacgtccgtagggcggtacgtacgtaccgtacgtaccgttaccgtaaccggtctttaacgttaccgtacggtacttcggacccacggtcggacgacggtaccctggcctaccggtcctcgtcacncctaccgacgtacgccctagtcccgtcccttcccgcgcctacccgtcctacccgaagtccgaccgtacccgttcgggaccgggtacaccgaccggtaccgccgtcggtcgcggtcctacggtacgacgtaccttcgtacgaccgtgttacgtcgtacgtcggacggtccgggtaggtacggaacggtaacggcccgtaagtacccgtaggntaccgctgtcgtac

SEQ ID NO: 172989 - DNA, 662 bp, Homo sapiens
  misc_feature: GYAE6OF01CT0G8.22.78.H01.1.454.CMB.1.raw
  modified_base (161)..(161): a, c, t, g, unknown or other
  misc_feature (161)..(161): n is a, c, g, or t
  modified_base (658)..(662): a, c, t, g, unknown or other
  misc_feature (658)..(662): n is a, c, g, or t
tcagacatacgcgtcacgaccggtgctcgatttagtgtgagtagtttgggtttggggggggtcctcgagactctcctgtagaggctctggattcacctttaagtcttatgccatgaccttggatcccgccagactccgggggaagggactggagtgggtcncgaccatcactggaactggaattagtacttactacgcagagtccgtagaagggtcgttcaccatctcagagacactccaggactacttgtttattagactatagaagcgctgcgcactgccggacaccggcctcttatttcgtgtgtacaaagccgaggtcgggcgactcgtaacgacttaccgtaacggcttaacgttacgtacggtctttacggacaccgtcggggaccaacgggtacccttggcctaccgtcctcacacgccctaccgaaccggacggaccctagttccggtccctttcccccgcggtccctaccccgtcccgaacccgaacggacgtaccgtacccgtccgggtccggggaccaccgaccggcccggtcccggtgggtccgtcgtcccgtacgggtaccgtaacggtaccttaccgtccgtacgtcgttacgtacgtcgtacggcggtcgggacgttacgggacgacgggcgtacacgtgacnnnnn

SEQ ID NO: 172990 - DNA, 849 bp, Homo sapiens
  misc_feature: GYAE6OF01EWS5R.22.78.H01.1.454.CMB.1.raw
  modified_base (470)..(470): a, c, t, g, unknown or other
  misc_feature (470)..(470): n is a, c, g, or t
tcagacatacgcgtcacgaccggtgctcgattttagtgtgagtagtttggggtttgggggggggtcctcggagactctcctgtagaggctctggattcacctttaagtcttatgccatgacctggactcccgcagactccgggggaaggactggagttgggtcgcgaccattccactggaactggaattagtactactacgcagagtccgtggaagggtacggttcaccgatcctaccgagtagacctaactcccgaaggacctacgttgttttaattagacctaagtcggaaggagtcccttgccgtcgtacgtcgaccggtaccaccggtccgttcttatttctgtgtacaacgtcagggcgggacgtagtcgtaacgtagttacccgtaacgggtcttaatttaaccgtaggttatttacggaccgtaccggtcgggggtaccaaccggggtacccgttggtacccnccgttccgtaccctcgtacaccccgtaccaaccgtaccgggtaccctacggtttcccgttccccgttacccccgttcggtacccctaacccccgttacccgtaacccgtaaaccgaccggtcccgtaaccccggttccgggtaccggggttacccaaccgtaacccgggtcccggtaccccggtttccggggaccctcggtaccccggttaccggtaccggaaaccgggttacccgttacccgttaccccgtaccggttaccgttaacggttccggttacgttaccgggaacgggttccgggggtacccggtagggacccggtaaacggggcctaaaccggtacgttaacgggttcaaacggcgggtaaccgcggtacg

SEQ ID NO: 172991 - DNA, 128 bp, Homo sapiens
  misc_feature: GYAE6OF02I6A0Z.22.78.H01.1.454.CMB.1.raw
  modified_base (128)..(128): a, c, t, g, unknown or other
  misc_feature (128)..(128): n is a, c, g, or t
tcagacatacgcgtcacgaccggtgctcgatttagtgtgagtagttgggttgggcacagcggccctgggctgcctggtcaaggactacttccacgcgtatgtctgagcgggctggcaaggcgcatagn

SEQ ID NO: 172992 - DNA, 520 bp, Homo sapiens
  misc_feature: GYAE6OF02ISGBD.22.78.H01.1.454.CMB.1.raw
  modified_base (515)..(520): a, c, t, g, unknown or other
  misc_feature (515)..(520): n is a, c, g, or t
tcagacatacgcgtcacgaccggtgctcgatttagtgtgagtagtttgggtttggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaaggcccatcgtctcccctgcaccctcctccagacgcacctctggggcacagcgccctggctgcctggtcaaggctacttccacgcgtatgtctgagcgggctggcaaggcgcatagnnnnnn

SEQ ID NO: 172993 - DNA, 547 bp, Homo sapiens
  misc_feature: GYAE6OF02HQJHI.22.78.H01.1.454.CMB.1.raw
  modified_base (542)..(547): a, c, t, g, unknown or other
  misc_feature (542)..(547): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcgatctacgatcctaacggctattactacggatttgacacctggggccagggaaccctggtcaccgtctcctcagccctccaccaagggcccatccgtcttccccctggccaccctcctcccaagacgccacctcgtcggggccacgacgccggccctgggcctcgccgtggtccaagggactacttccacgcgtatgtctgagcgggctggcaaggcgcgatagnnnnnn

SEQ ID NO: 172994 - DNA, 174 bp, Homo sapiens; identical to SEQ ID NO: 172957
  misc_feature: GYAE6OF02GC8Z3.22.78.H01.1.454.CMB.1.raw
  modified_base (173)..(174): a, c, t, g, unknown or other
  misc_feature (173)..(174): n is a, c, g, or t

SEQ ID NO: 172995 - DNA, 545 bp, Homo sapiens
  misc_feature: GYAE6OF02HU5S7.22.78.H01.1.454.CMB.1.raw
  modified_base (539)..(540): a, c, t, g, unknown or other
  misc_feature (539)..(540): n is a, c, g, or t
  modified_base (542)..(545): a, c, t, g, unknown or other
  misc_feature (542)..(545): n is a, c, g, or t
tcagacatacgcgtcacgaccggtgctcgatttagtgtgagtagtttgggtttgggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcgacacggccgtctatttctgtgtcaaagccagcgggcggatctacgatcctaacggctattactacggatttgacactggggccagggaaccctggtcaccgtctcctcagccctcaccaacgggcccagtccggtcttccccctggccacccctccctccaagacgccacctctcggggcacgagccggccgtgggcctgccgtggtcgaaggactacttccacgcgtactgtctgacgcgggctggcaaggcgcagtagnngnnnn

SEQ ID NO: 172996 - DNA, 570 bp, Homo sapiens
  misc_feature: GYAE6OF02FMZT4.22.78.H01.1.454.CMB.1.raw
  modified_base (564)..(564): a, c, t, g, unknown or other
  misc_feature (564)..(564): n is a, c, g, or t
  modified_base (566)..(569): a, c, t, g, unknown or other
  misc_feature (566)..(569): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagcagcgggcggatctacgatcctaacggctattactacggatttgacacctggggccagggaaccctggtcaccgtctcctcagcctccaccaagggccccatccggtccttccccctcggccacccctccctccaacgacgccaccctcgtcggggccaccgacgccggcccgtcgggcctcggcctgggtccgaacggacctacttccgacgtcgtatcgtctgacggcggtcgtcggcgacggcgcgagtacgnannnng

SEQ ID NO: 172997 - DNA, 608 bp, Homo sapiens
  misc_feature: GYAE6OF02I12Y9.22.78.H01.1.454.CMB.1.raw
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactccaggacactgtttattagacatgaagagcctgcgcactgcgacacggccgtctatttctgtgtcaaagccagcgggcgatctacgatcctaacggctattactacggtatttcgacacgtgggccagggaaccctggtcaccgtctcctcacgccctccaccgaacggcccagtccgtcctccccgtgccctacccgtcctccaacgacgccaccgtcgtcggggccacgacggccggcccgtcgggcctcgccgtcggtacgaacggtaccttaccgttacccgacgtaccgttacgtacgttccgtacggacggaccgggtcgtacggacgtaacgggccgtacgaacgttacggcgtancncgngtc

SEQ ID NO: 172998 - DNA, 588 bp, Homo sapiens
  misc_feature: GYAE6OF02I43R1.22.78.H01.1.454.CMB.1.raw
  modified_base (292)..(292): a, c, t, g, unknown or other
  misc_feature (292)..(292): n is a, c, g, or t
  modified_base (583)..(584): a, c, t, g, unknown or other
  misc_feature (583)..(584): n is a, c, g, or t
  modified_base (586)..(588): a, c, t, g, unknown or other
  misc_feature (586)..(588): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtntatttctgtgtcaaagccaggcgggcggatctacgatccgtaacggctattactacggtatttgacacgtggggccaggggaaccctggtcaccgtctcctcactcctaccaccgaaggcccatccggtccttccccgtcggccaccctcctccaagacgccacctcgtcggggcacgacgccggcccgtcgggctcgcctcggtacgaacggtaccttaccgttcccgaccgtcgttaagtcgtcgtcggacggtcggggcgtcgggacgaacgggccgacgagtacggnncnnn

SEQ ID NO: 172999 - DNA, 615 bp, Homo sapiens
  misc_feature: GYAE6OF02HR59H.22.78.H01.1.454.CMB.1.raw
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacggttcaccatctccagagacaactccaggacactgtttattagacatgaagagcctgcgcactgcggacacggccgtctatttctgtgtcaaagccagcgggcggatctacgatcctaacggctattactacggatttgacaccgtggggccaggggaaccctggtccaccgtctcctcacgcctccaccaacggcccagtccgtccttccccgtcgcctacccctcctaccaacgacgaccacctcgtcgggggccacgacgccgggcccgtcgggccgtcgcccgttgggtaccgaaacggtaccttaaccgttcccgaccggtacgttacgtcgtcgttacggacggtccggggcgtacggggaccgaacgggccgaacgacgtacggnancgcancg

SEQ ID NO: 173000 - DNA, 530 bp, Homo sapiens
  misc_feature: GYAE6OF02GJZN2.22.78.H01.1.454.CMB.1.raw
  modified_base (525)..(530): a, c, t, g, unknown or other
  misc_feature (525)..(530): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccagggaaccctggtcaccgtctctcagcctccaccaaggcccatcggtcttcccctggcaccctcctccaagacgcacctctggggcacagccggccctgggctgcctggtcaaggctacttccacgcgtatgtctgagcgggctggcaaggcgcatacgnnnnnn

SEQ ID NO: 173001 - DNA, 206 bp, Homo sapiens
  misc_feature: GYAE6OF02IWBHA.22.78.H01.1.454.CMB.1.raw
  modified_base (177)..(206): a, c, t, g, unknown or other
  misc_feature (177)..(206): n is a, c, g, or t
tcagacatacgcgtcacgaccggtgctcgatttagtgtgagtagtttgggtttggggggaaggaggaagactggacggtccccccaggagttcaggtgctgggcacagcggccctgggctgcctggtcaaggactacttccacgcgtatgtctgagcgggctggcaaggcgcatagnnnnnnnnnnnnnnnnnnnnnnnnnnnnnn

SEQ ID NO: 173002 - DNA, 629 bp, Homo sapiens
  misc_feature: GYAE6OF02G7UTT.22.78.H01.1.454.CMB.1.raw
  modified_base (621)..(621): a, c, t, g, unknown or other
  misc_feature (621)..(621): n is a, c, g, or t
  modified_base (628)..(629): a, c, t, g, unknown or other
  misc_feature (628)..(629): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacgttcaccatctccagagacaactccaggacactgtttattagacatgaagagcctgcgcactgcgacacggccgtctattctgtgtcaaagccagcgggcgatctacgatcctaacggctattactacggtatttgactaccgtcggggccacggggtaaccctggtacaccgtctcctcacgccctaccaaccgaacgggccccagttccggtccttcccccgtcggacccacccctccctacccaacgaccgccacccgtccggtcggggccaccgacgccgggtcccgtcgggccgtcgccgtcgggtacgtaacgggtaccttaccgttacccgaccgtacggttacttacgtcgtaggacggtccgggcgttcgggacgtaacgggccgtacgtagtacggncactcgnn

SEQ ID NO: 173003 - DNA, 608 bp, Homo sapiens
  misc_feature: GYAE6OF02GUQCZ.22.78.H01.1.454.CMB.1.raw
  modified_base (602)..(604): a, c, t, g, unknown or other
  misc_feature (602)..(604): n is a, c, g, or t
  modified_base (606)..(608): a, c, t, g, unknown or other
  misc_feature (606)..(608): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccaggggaaccctggtcaccgtctcctcagccctccaccgaagggcccagtccggtccttccccctggccacccctccctcccaacgacgccacctccgtcgggggccacgacggccggcccgtcggggcctcggcccgtgggtccgaaacgggaccttaccgtttcccgaaccgtccgttaacgtcgttccgtcggacggtccggggtccgtagggaccgaaggccggacgacgtacgnnngnnn

SEQ ID NO: 173004 - DNA, 584 bp, Homo sapiens
  misc_feature: GYAE6OF02FQAHV.22.78.H01.1.454.CMB.1.raw
  modified_base (578)..(579): a, c, t, g, unknown or other
  misc_feature (578)..(579): n is a, c, g, or t
  modified_base (581)..(584): a, c, t, g, unknown or other
  misc_feature (581)..(584): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccagggaaccctggtccaccgtctcctcacgcctccaccaacgggcccagtccggtccttccccctggccacccctccctccaacgacgccaccctcgtcggggccacgacgccggcccgtcgggcctcgccgtcggtccgaacggaccttaccgttcccaacgtcgttaattcgtcgtggacgcgggtcgtcggacgaaggccgacgacgtagnngnnnn

SEQ ID NO: 173005 - DNA, 623 bp, Homo sapiens
  misc_feature: GYAE6OF02IZ4SE.22.78.H01.1.454.CMB.1.raw
  modified_base (303)..(303): a, c, t, g, unknown or other
  misc_feature (303)..(303): n is a, c, g, or t
  modified_base (618)..(623): a, c, t, g, unknown or other
  misc_feature (618)..(623): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtntcaaagccaggcgggcggatctacgatcctaacggctaacttactacggtatttgaccacgtcggggccacggggaaccctggtaccgaccgtctaccctcacgccctcccgaaccgaccgggccctagtcccggttccttccccccgtcggtcccaccccgtaccctacccaacgacgacctacccgtccggtacgggggccacggacgccggtcccgtgggccgtcgccgtcggtaccgaacggtacctacgttcccgacggtacgtacgtgttccgtgacggcgggccgtcggacgaacggcgacgagtcgnnnnnn

SEQ ID NO: 173006 - DNA, 613 bp, Homo sapiens
  misc_feature: GYAE6OF02HRGQM.22.78.H01.1.454.CMB.1.raw
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
tcagacatacgcgtcacgaccggtgctcgatttagtgtgagtagtttgggtttgggggggggtcctcgagactctcctgtagaggctctggattcaccttttaagtcttatgccatgacctggatccgccagactccggggaaggactggagtgggtcgcgaccatcactggaactggaattagtacttactacgcagagtccgtgaagggacggttcaccatctccagagacaactccaggacacttgtttattagacatgaagagcctgcgcactgcggacacggccgtctatttctgtgtcaaagccaggcggcggatctacgatcctaacggctattacacggtatttgacaccgtggggccagggaaccctggtcaccgtctcctcacgccctccaacctaacgggcccagttcccggtcctttcccccgtcggcctacccctccctccgaacgacgccaccgtcgtcggggccaccgacggccggtcccgtgggccttcgcccgttcggtaccgaaacgggaccttaccgttcccgtaccggacgttacgtcgtctggacggtccgggcgtcggacgaacgggccgacgtactaggntacgngngnn

SEQ ID NO: 173007 - DNA, 541 bp, Homo sapiens
  misc_feature: GYAE6OF02HCHMD.22.78.H01.1.454.CMB.1.raw
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
  modified_base (535)..(537): a, c, t, g, unknown or other
  misc_feature (535)..(537): n is a, c, g, or t
  modified_base (539)..(541): a, c, t, g, unknown or other
  misc_feature (539)..(541): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctattctgtgtcaaagccaagcgggcggatctacgatcctaacggctattactaacggatttgacacctggggccaaggggaaccctggtcaccgtctcctcagcctccaccaaggcccatcgtcttcccctggcaccctccctccaagacgcacctctggggcacacgcggcccgtgggctgccgtggtcgaacggactacttccacgcgtaatgtcngagcgggctggcaaggcnagtagnnngnnn

SEQ ID NO: 173008 - DNA, 583 bp, Homo sapiens
  misc_feature: GYAE6OF02HAJIR.22.78.H01.1.454.CMB.1.raw
  modified_base (578)..(583): a, c, t, g, unknown or other
  misc_feature (578)..(583): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacgttcaccatctccagagacaactcccaggacactgtttattagacatgaagagcctgcgcactgcggacacggccgtctatttctgtgtcaaagccaggcgggcggatctacgatcctaacggctattactaggatttgacacctggggccaggggaaccctggtccaccgtctcctcacgccctccaccaacgggcccagtccggtccttccccctcggccacccctcctaccaacgacgccaccctcgtcggggacacgacgccggcccgtgggcctgcccgtggtaccgaacggaacctccttaccgaccgacgttactgtcgtgacggccgggcttcgggcgaacgggccgacgattacgnnnnnn

SEQ ID NO: 173009 - DNA, 728 bp, Homo sapiens
  misc_feature: GYAE6OF02H7QVJ.22.78.H01.1.454.CMB.1.raw
  modified_base (723)..(723): a, c, t, g, unknown or other
  misc_feature (723)..(723): n is a, c, g, or t
  modified_base (726)..(727): a, c, t, g, unknown or other
  misc_feature (726)..(727): n is a, c, g, or t
tcagacatacgcgtcacgaccggtgctcgatttagtgtgagtagtttgggtttggggggggggtcctcgagactctcctgtagaggctctggattcacctttaagtcttatgccatgacctggatccgccagactccgggggaagggactggagtgggtcgcgaccatcactggaactggaattagtacttactacgcagagtccgtgaagggacggttcaccatctccagagacaactccaggacactgtttattagacatgaagagcctgcgcattgcggacacggccgtctatttctgtgtacaaaagccgagcgggcggatctacgatccaacggctattactacggtattgacaccgtgggggaccaacgggaaccctgggtaccaccggttctccctacacgcccttaccaacccgaaacggggcccctaacgttcccgggttacccgtttcccccccgttcgggtcccctaccccctttaccccttaccccgaaaacggaccggaccctaacccgttccgggttacgggggggccaaaccgacgggcccgggtccccggtcggggccgttcggtcccgttacgggtaccgtaaacgggtaacccgttaacccgtttcccgaaccggtaccggttaacgttcggttaccgttcggaacgggtccgggggtccggttacgggaccggaaacgggtccggaccgtacgttaaggacganagnnc

SEQ ID NO: 173010 - DNA, 602 bp, Homo sapiens
  misc_feature: GYAE6OF02GR1A6.22.78.H01.1.454.CMB.1.raw
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacgttcaccatctccagagacaactcccaggacactgtttattagacatgaagagcctgcgcactgcggacacggccgtctatttctgtgtcaaagccagcgggcggatctacgatcctaacggctattactaggatttgacacgtggggccagggaacctggcaccgtctcctcacgcctccaccgaaggcccagtccggtccttcccccgtgcccacccctcctaccaacgacgccacccgtcgtcggggcaccgacggccggcccgtcgggcctcgccgtcgggtaccgaaacggtacctaccgttcccgacgtacgttaacgtcgtcgtcggacggccgggtcgtcgggacggaacggccggtacgaacgtacgtacncgnactncg

SEQ ID NO: 173011 - DNA, 621 bp, Homo sapiens
  misc_feature: GYAE6OF02FSA1R.22.78.H01.1.454.CMB.1.raw
  modified_base (318)..(318): a, c, t, g, unknown or other
  misc_feature (318)..(318): n is a, c, g, or t
  modified_base (613)..(613): a, c, t, g, unknown or other
  misc_feature (613)..(613): n is a, c, g, or t
  modified_base (615)..(617): a, c, t, g, unknown or other
  misc_feature (615)..(617): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccaggcgggnggatctacgatcctaacggctattactacggtatttgacaccgtggggaccacgggaaccctggtccaccgtctcctcacgccctccaccaacgggcccagtccggtccttcccccgtcggcccacccctccctaccaacgacgccacccgtcgtcgggggccaccgacgccggcccgtcgggccgtcggccgtcgggtccgaacgggtaccttaccttacccgacgccgttagtcgttcgtcggacgggccggggtccggtcgggaccgaacgggcgaccgaagttacggacgngnnntacg

SEQ ID NO: 173012 - DNA, 556 bp, Homo sapiens
  misc_feature: GYAE6OF02F5KWX.22.78.H01.1.454.CMB.1.raw
  modified_base (265)..(265): a, c, t, g, unknown or other
  misc_feature (265)..(265): n is a, c, g, or t
  modified_base (534)..(534): a, c, t, g, unknown or other
  misc_feature (534)..(534): n is a, c, g, or t
  modified_base (551)..(556): a, c, t, g, unknown or other
  misc_feature (551)..(556): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaanagcctgcgcactgcggacacggccgtctatttctgtgtcaaaagccagcgggcggatctacgatcctaacggctattactacggatttgacaccgtggggccagggaaccctggtcaccgtctctcagcctccacccaaagggccccagtccggtccttcccctcggccaccccgtcctccaagtacgcacctcgtcggggcacgagccggccctcgggcctgcccgtggtcgaacggtactacttccacgcgtatgctgagcgggccnggcgaggcgcacgtagnnnnnn

SEQ ID NO: 173013 - DNA, 652 bp, Homo sapiens
  misc_feature: GYAE6OF02HDPRI.22.78.H01.1.454.CMB.1.raw
  modified_base (266)..(266): a, c, t, g, unknown or other
  misc_feature (266)..(266): n is a, c, g, or t
  modified_base (645)..(645): a, c, t, g, unknown or other
  misc_feature (645)..(645): n is a, c, g, or t
  modified_base (648)..(648): a, c, t, g, unknown or other
  misc_feature (648)..(648): n is a, c, g, or t
tcagacatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacgttcaccatctccagagacaactcccaaggacactgtttattagacatgaagancctgcgcactgcggacacggccgtctatttctgtgtacaaagtccaggtccgggcgagtcctacgataccgtaacggcttattacgtacggtatttgacctaccgtgggggccaacgggggaacccctgggtaccaccggtctccctcgacgccctaccgacccgaagggccccacgttccggtccttcccccgtcggccctacccctaccctacccaacgacgccacccgtccgtcggggccacgacgccggcccgtcgggcctcggcccgtcggtccgtaacggtaccgttactttacccgaccggtacgtaacttcggttcgtcgacgggtccggggtccgtcggaccggtaacgggccgtaccgacgtacgcgcncgngtgc

SEQ ID NO: 173014 - DNA, 596 bp, Homo sapiens
  misc_feature: GYAE6OF02G8QLO.22.78.H01.1.454.CMB.1.raw
  modified_base (591)..(592): a, c, t, g, unknown or other
  misc_feature (591)..(592): n is a, c, g, or t
  modified_base (594)..(596): a, c, t, g, unknown or other
  misc_feature (594)..(596): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctattctgtgtcaaagccaggcgggcggatcgtacgatacctaacggctattactacggatttgactaccgtgggccagggaccctggcaccgtctcctcacgccctaccaccgacggcccatcccggtccttccccgtcgccacccctcctacccaacgacgaccaccctacgtcgggggtaccacgacgccggcccgtcggcctcgccgttcggtccgaaacggtacccttaccgttcccgacgaccgttagtcgtacgtcgacggccggcggtcggacgaacggcgacgacgtggcnncnnn

SEQ ID NO: 173015 - DNA, 743 bp, Homo sapiens
  misc_feature: GYAE6OF02JXL53.22.78.H01.1.454.CMB.1.raw
tcagacatacgcgtcacgaccggtgctcgatttagtgtgagtagtttgggtttggggggggtccgtcgagactctcctgtagaggctctggattcacctttaagtcttatgccatgacctggactccgccagaccgtccgggggaaggactgggaggtgggtccgcggacctatcgaactgggaactggaaattgtacttaactacgcaggtacgtccgtagaaggggcttcaccatctccgagacgaccaactcccaggacaccttgttttaagttacgacgattacggaaagacggcccttaggccgcgtaaccgtcggacggaccgaaccgggtccgttaccttaagtttccgtaggtacgtacgaaacgtcccgaggccgggacggactacgtacgaccgttccgaaacggtactacgttaacgtacgtactttaggaccgtacggtacggaccgacggtaaccgttcggaccgtacgtcctccgtacgcgacctacccgaaccgaaccgggtcctaacgtcccgtcccgtcccgtccgcccgtacccgtcccgtaccgtacgaccgtaccgtacccgtcggcgggacctacgaccggacccggtccgtacggtccgtacggtcgtaccggtacgaaccggtaccgtaccgttaccgaccgtcggtaccgtcgtaccgtcggacggtccgggcgtccggtacggaaccggtcgtaacgcgtacgcgacgtcgactgccg

SEQ ID NO: 173016 - DNA, 859 bp, Homo sapiens
  misc_feature: GYAE6OF02HG08P.22.78.H01.1.454.CMB.1.raw
  modified_base (850)..(850): a, c, t, g, unknown or other
  misc_feature (850)..(850): n is a, c, g, or t
  modified_base (858)..(858): a, c, t, g, unknown or other
  misc_feature (858)..(858): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactccaggacactgtttattagacatgaagacgcctgccgacactgcggacacggccgtactagtttctgtgtacaaagtccaaggccgggacggactccgtaacgactaccgtaaaccggtcttaacgttaaccgttaacgggtacttttacgaaccgtacccgttacgggggcccggaaaccggggtaaaccccgtttgggttacccgaaccccgggtttccctacccgttaccgacccggtacccctaccccgtaaaccccggaacccggggaccccctaacgttcccgggtttaccccgtttaccccccggttccgggtacccctaaccccccgtaccccgttaaccccgtaaacggtaaccggtacccgaaccccggttacccggttacgggggggaacccgaaacccggaaccgggtccccgggtaccccggttccgggggtaccgttccgggtccccgttacggggttaacccggtaaaccggtaaaccgttaacccgttaaccgacccggtaaccgttaacggttacgttaccgggttaccggaagggttcccggggtcggtaacgggtaccgggaaaccgggtccggtaacgtaacggtaacgacgnacggcagng

SEQ ID NO: 173017 - DNA, 576 bp, Homo sapiens
  misc_feature: GYAE6OF02F1VWH.22.78.H01.1.454.CMB.1.raw
  modified_base (571)..(572): a, c, t, g, unknown or other
  misc_feature (571)..(572): n is a, c, g, or t
  modified_base (574)..(576): a, c, t, g, unknown or other
  misc_feature (574)..(576): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcggggcggatctacgatcctaacggctattactacggtattttgacaccgtggggccaggggaaccctggtcaccgtctcctcagcctccaccaaggcccagtccggtccttcccctcggccacccctcctccaacgacgccacctcgtcggggcacgacgccggcccgtcgggcctcggcctcgggtacgaacggtaccttaccgttccaccgtcgtacttcgtctgacggcgggcgtcggcgaaggccgcgagtagnncnnn

SEQ ID NO: 173018 - DNA, 594 bp, Homo sapiens
  misc_feature: GYAE6OF02GW0BQ.22.78.H01.1.454.CMB.1.raw
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggcgttcaccatctccaganacaactcccaggacacttgtttattagacatgaaagagcctgcgcactgcggacacggccgttntatttcngtgtacaaaagccaggcgggcgatcgtaacgntaccgtaacggctaattacacggtatttacgacacgtcggggaccaacgggaaccctggtccaaccgtctctcacgccctacaaccgaaggcccagtccgtcctccctcgccaccctcctaccaagacgaccaccgtcgtcgggacacgcgccggccgtcggctcgccgtcggtacgaacgtactaccgtccgacgacgttaacgtcgtacgtacggacggccgggcgtacggacgtaacggcgtacgagtacgacgncngnn

SEQ ID NO: 173019 - DNA, 608 bp, Homo sapiens
  misc_feature: GYAE6OF02FMPEI.22.78.H01.1.454.CMB.1.raw
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggcgttcaccatctccagagacaactcccaggacactgtttattagacatgaagagcctgcgcactgcggacacggccgtctatttctgtgtcaaagccagcgggcgatctacgatcctaacggctattactacggtatttgacaccgtggggcccaggggaaccctggtccaccgtctcctcagcctccaccgaacgggccccagtccggtccttccccctcggtcccacccctccctcccaagacgccaccctcgtcgggggcacgacgcccggcccgtcgggcctcgtccgtcgggtacaacggtacttaaccgttccaccgtcgtacgttcgttccgtcggacggccgggtcgtcgggaccgaaacgggccgaccgaagttacgngtancgtgcn

SEQ ID NO: 173020 - DNA, 188 bp, Homo sapiens
  misc_feature: GYAE6OF02H7TLE.22.78.H01.1.454.CMB.1.raw
  modified_base (174)..(188): a, c, t, g, unknown or other
  misc_feature (174)..(188): n is a, c, g, or t
tcagacatacgcgtcacgaccggtgctcgatttagtgtgagtagtttgggtttgggggaagaggaagactgacggtccccccaggagttcaggtgctgggcacagcggccctgggctgcctggtcaaggactacttccacgcgtatgtctgagcgggctggcaaggcgcatagnnnnnnnnnnnnnnn

SEQ ID NO: 173021 - DNA, 731 bp, Homo sapiens
  misc_feature: GYAE6OF02H6CWX.22.78.H01.1.454.CMB.1.raw
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaagggactggaggtgggtcgcgaccatcactggaactggaattagtacttactacgcagagtccgtgaagggtacggttcaccatctccaganacaactcccaggaccacttgtttattagacatgaagacgcctgcgcactgccggacacggccgtctatttcngttgtacaaacgccaggcgggcgactctacgataccgtaacggcttaagttactacggtatttacgacctaccgtggggccgaacggggtaacccttggtcctacccggtcttacctccgacgtcctacccaccgaacgggccctacgttcccggtaccttcccccgttcggccctaccccgtcctaccgaacgacgcctacccttccggtacggggtcgacgacggcccgggtcccgtcggggtccgtcgtacccggttcggtacccgtaacgggtaaccgtttacccgttaacccgtaacccggtacgttaaccgttccggttaccggtacgggtacgggtacccggggttaccgggtaccgggtacccggtaaccgggtacccgacccggttagtaacgggtcaacggtccgtagtacgtcgg

SEQ ID NO: 173022 - DNA, 629 bp, Homo sapiens
  misc_feature: GYAE6OF02IDYBL.22.78.H01.1.454.CMB.1.raw
  modified_base (217)..(217): a, c, t, g, unknown or other
  misc_feature (217)..(217): n is a, c, g, or t
  modified_base (406)..(406): a, c, t, g, unknown or other
  misc_feature (406)..(406): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
  modified_base (627)..(629): a, c, t, g, unknown or other
  misc_feature (627)..(629): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggacggttnaccatctaccagagacaacctccaggacacttgttttattagacatgaagtagcctgcgcactgacgacacggccgtctatttctgtgtacaagccaggcggacggatctacgactccgtaacgcttacttactacggtattttagactaccgtggggaccgacgggtaaccgtcggtcaccgtctccncacgccctccgaaccgaccgggaccctcgtccgttcccttccccgtccggccctacccctcccgtcaaacgcgaccgtacccgtcggtacggggccacgacggcccggtaccgtcgggcctcggtccgttaggtccgaaaccgggtacctaccgtttccgacgtacgttacttcgttcgaggacggcggtcgtacggacggacgtcganacgtagcgtncnnn

SEQ ID NO: 173023 - DNA, 781 bp, Homo sapiens
  misc_feature: GYAE6OF02GSON3.22.78.H01.1.454.CMB.1.raw
  modified_base (299)..(299): a, c, t, g, unknown or other
  misc_feature (299)..(299): n is a, c, g, or t
  modified_base (773)..(773): a, c, t, g, unknown or other
  misc_feature (773)..(773): n is a, c, g, or t
  modified_base (775)..(775): a, c, t, g, unknown or other
  misc_feature (775)..(775): n is a, c, g, or t
  modified_base (778)..(778): a, c, t, g, unknown or other
  misc_feature (778)..(778): n is a, c, g, or t
  modified_base (780)..(781): a, c, t, g, unknown or other
  misc_feature (780)..(781): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactgaagtgggtcgcgaccatcactggaactggaattagtacttactacgcagagtccgtgaagggacggttcaccatctccagagaacaactcccaggacacttgtttattagacatgaagacgcctgcgcactgcgacacggcctctatttcngtctcaaacgccaggcgggcggatctaacggactaccgtaacggtactaagtttacgtaacgggtattttcggaacctaccggttcggggggacccgtaaacgggggtaaaccccgtttgggtacccgtaaccccggtttccctcccctttacgaaccggccccttaccccgtaaacccgaaaccgggggtaccccctaacgttccccgggtttacccctttcccccccggtacgggtacccctaaccccccgttcccctaacccgaacgtaccggtaccctacccgtaccgggttcgggggacctaccgaccggacccgggccccgtaggggtcccgttcggtccccgttagggtacccgtaaacgggttaaccctttacccgttaacccgtaccggaccgtttaacgtcggtttacccgtaggacgggccgggtcggttacgggacggtaacggcggtaccaacggtacggngncgngnn

SEQ ID NO: 173024 - DNA, 659 bp, Homo sapiens
  misc_feature: GYAE6OF02HQ57S.22.78.H01.1.454.CMB.1.raw
  modified_base (653)..(653): a, c, t, g, unknown or other
  misc_feature (653)..(653): n is a, c, g, or t
  modified_base (655)..(658): a, c, t, g, unknown or other
  misc_feature (655)..(658): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatcccgccagactccggggaagggactggagtgggtcgcgaccatcactggaactggaattagtacttactacgcagagtccgtgaagggacggttcaccatctccagagacaactcccaggacacttgtttattagactatagaagagcctgcgcactgcggacaccggtccgtcttatttctgtcgtacaaagcccaggcggggacgtatcgtacgatccgtaacgggcttattaaccgtagtattttagaccgtacgtcggggaccacggggaaccctgggtaccaccgttcctcctacacgccctaccaaccgaaccgggtcccctagtcccggttcccgtttccccctcggccctacccctcccgtacccaacgacgacctacccgtcggtcggggtccacgacggccggcccgtgggcctcggccctagggtaccgaacggtaccttaaccgtcccgtacggtcgttaacgttcgttccgaggtaccggaccggggtctacgggaccgtacggacgtcaagtcgngnnnnc

SEQ ID NO: 173025 - DNA, 660 bp, Homo sapiens
  misc_feature: GYAE6OF02GAGAY.22.78.H01.1.454.CMB.1.raw
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (658)..(659): a, c, t, g, unknown or other
  misc_feature (658)..(659): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactggagtgggtcgcgaccatcaactggaactggaattagtacttactacgcagagtccgtgaagggacgttcaccatctcagagacaactcccaggacacttgtttattagactatgaagagcctgcgcactgcggacacggccgtctatttctgtgtcaaagccagcgggcgatcgtacgactccgtaacggctacttacgtacggtatttcgactaccgtcgggaccagggaaccctggtccaccgttctccgtcacgccctaccaaccgaacggcccacgttccggtcccttcccccgtcggtcccctaccccgtaccctaccgaacgaccgtacctaacccgtcggtccgggggacctaccgacggcccggcccgttcgggccgtccggccgttacggtaccgtaaacggtacctttaccgttacccgtaccgtcgttacgtacgttccgtacggacgggccgggtacgttcgggacggtaacggccgtacgtaacgtacggancgngnnc

SEQ ID NO: 173026 - DNA, 809 bp, Homo sapiens
  misc_feature: GYAE6OF02FUW8K.22.78.H01.1.454.CMB.1.raw
  modified_base (264)..(264): a, c, t, g, unknown or other
  misc_feature (264)..(264): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggacggttcaccatctccagagacaactcccaggacactgtttattagacatgaanagcctgcgcactgcggacacggcctctatttctgtgtacaaacgccaggcgggccggatctacgatccgtaaacggtctaagtttacctacggtattttacgacctaccgttcgggggacccaacggggtaaccccttcgggtaccgacccgtttaccgtccctacgaccggtcccctacccgaacccgaacggggtaccccctaacggttcccggttccccttttacccccggtcggtacccctaacccccgttccctaacccgtaaacggtaccgaccccgtaaccccgtccgggtaccgggggtacccaacccggaacgggtcccccggggtaccccgttcgggggtacccttccgggtacccgttacggggtaaccccggtaaacgggtaccccgtttaacccgttcccgtaaaccggtcccggtttaacgttcccggtttacgtacgggtaccgggtacccgggggttccgtaaccggggtacccggtaaacggggtcccgtaacggtaaccggttacggacgttcgcgttaggatccgg

SEQ ID NO: 173027 - DNA, 575 bp, Homo sapiens
  misc_feature: GYAE6OF02FS3WM.22.78.H01.1.454.CMB.1.raw
  modified_base (391)..(391): a, c, t, g, unknown or other
  misc_feature (391)..(391): n is a, c, g, or t
  modified_base (540)..(540): a, c, t, g, unknown or other
  misc_feature (540)..(540): n is a, c, g, or t
  modified_base (570)..(570): a, c, t, g, unknown or other
  misc_feature (570)..(570): n is a, c, g, or t
  modified_base (572)..(575): a, c, t, g, unknown or other
  misc_feature (572)..(575): n is a, c, g, or t
tcagacatacgcgtcacgaccggtgctcgatttagtgtgagtagtttgggtttggggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcggggcggatctacgatcctaaacggctaattactacggatttagacacctggggccagggaccctggtcaccgtcncctcacgcctccaccgaaggcccagtccggtccttccccgtcgtccacccctcctcccaagacgccacccgtcgtcgggggcaccgacggccggcccgtgggcctcgccgtcggtcgaagtactaccttccacgtcgtaacgtgtctgnggtcgggcctggacgacggcgacgagtagnannnn

SEQ ID NO: 173028 - DNA, 206 bp, Homo sapiens
  misc_feature: GYAE6OF02GV912.22.78.H01.1.454.CMB.1.raw
  modified_base (175)..(206): a, c, t, g, unknown or other
  misc_feature (175)..(206): n is a, c, g, or t
tcagacatacgcgtcacgaccggtgctcgatttagtgtgagtagtttgggtttgggggaagaggaagactgacggtccccccaggagttcaggtgctgggcacagcggccctgggctgcctggtcaaggctacttccacgcgtatgtctgagcgggctaggcaaggcgacatagnnnnnnnnnnnnnnnnnnnnnnnnnnnnnnnn

SEQ ID NO: 173029 - DNA, 679 bp, Homo sapiens
  misc_feature: GYAE6OF02JBLB5.22.78.H01.1.454.CMB.1.raw
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
tcagacatacgcgtcacgaccggtgctcgatttagtgtgagtagtttgggtttggggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggtcggttcaccatctcagagacaactccaggacacttgtttattagacatgaagagcctgcgcactgcggacgacggccgtcttactttctgttcgtacaaacgccgacggcggggcggactctacgagtaccgtaacggtactattacgttacggtatttagacctacggtcggggaccgacgggtaacccgtggtacctaccgtcctccgtcacgtccctaccaacccgacggcccgactcccggttcccttcccccgtcggccccgtaccccctccctaccgaacgtaccgaccctaccgtccggttacggggccgaccgacgggcccggtcccggtcgggccgttccgcccggttaggtaccgaaccggtacctaccgttacccgacgttaccgtagttcgtacgtacggcggtcgggtcgtcggtacggaacgggttacgacgtaacgacgtcgagtgnactn

SEQ ID NO: 173030 - DNA, 708 bp, Homo sapiens
  misc_feature: GYAE6OF02GS0O7.22.78.H01.1.454.CMB.1.raw
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagacatacgcgtcacgaccggtgctcgatttagtgtgagtagtttgggtttgggggggggtcctcgagactctcctgtagaggctctggattcacctttaagtcttatgccatgacctggatccgccagactccggggaaggactggagtgggtcgcgaccatcactggaactggaattagtacttactacgcagagtccgtgaagggacggttcaccatctccagagacaactccaggacactgtttattagacatagaagngcctgcgcacgtgcgacacggccgtctatttcngtcgtacaaacgccaggtcgggacggaatcgtaacggacttaccgtaacgggtcttaagttaaccgtaaggttacgtttcgaacctaccggtcgggggaccaacggggtaaccctgggttaccaccggtttcgtccttcgacgtcccttaccgaaacccgtaacggggacccctagttcccgggttccctttcccccgtcggacccctaccccgtcccgtacccaacgacgtcctacccgtcggtcggggtaccacgtacggccgggtacccgtcggccgtcggtccgttacgggtaccgaaacgtaccgttacgttacccgtacggtaccgttacgtacgttaccgtaggaccggtccggggtcgacggtccggaaaggccgtacgtaagtcggtacgagtctcgatcg

SEQ ID NO: 173031 - DNA, 854 bp, Homo sapiens
  misc_feature: GYAE6OF02HL1DP.22.78.H01.1.454.CMB.1.raw
  modified_base (160)..(160): a, c, t, g, unknown or other
  misc_feature (160)..(160): n is a, c, g, or t
  modified_base (586)..(586): a, c, t, g, unknown or other
  misc_feature (586)..(586): n is a, c, g, or t
  modified_base (843)..(843): a, c, t, g, unknown or other
  misc_feature (843)..(843): n is a, c, g, or t
  modified_base (848)..(848): a, c, t, g, unknown or other
  misc_feature (848)..(848): n is a, c, g, or t
tcagacatacgcgtcacgaccggtgctcgatttagtgtgagtagtttgggtttgggggggggtcctcgagactctcctgtagaggctctggattcaccgtttaagtcttatcgccatgacctggactccgcagacgtccggggaagcgtggagtgggtcncgaccatcacgtaggaaacctggtaaattacgtacttacgacggacaggtacgtccgtaggaaacggggtaccgttccaacctacgttacctaccggaaggaaccgtaacctaacccgttaccgaaaggggaaccttacgttttaggtttttaactaacgaacgtaagtacggaaagtaccgccgttacggaccgtacctaacgggttaggaccgggaaccgtacccggggttaccttactttacggttttatcggtaacgtaacgaaaccgcccggtaagggccggggtaactacgttacctaaccgtaaccgtacccgttacggaattttaagtaaaccggttagttaacgttcgaaccggtaccgggttcggggaaccctaaccgggacctttcgggtacccctaccggtcctttacccgganaaccccgtaccgtaacccaaaccgggtaccgtccgtaccggttacccgttcccgttaccccgtcgaacccgtccctaaccgtaaccgaacgtaccgtaccgtacggtacggtcgggaacacgtaccggccggtaccgtacgaccgtcgtacggtacgaaaccggtacgtacccgttacgtcctacgtacgtcgttggtacctcggacgggtcggtacggccggtaaggaccggaacgtacgttacgacgtaccggtnaacgngtacac

SEQ ID NO: 173032 - DNA, 603 bp, Homo sapiens
  misc_feature: GYAE6OF02H0S41.22.78.H01.1.454.CMB.1.raw
  modified_base (597)..(601): a, c, t, g, unknown or other
  misc_feature (597)..(601): n is a, c, g, or t
tcagacatacgcgtcacgaccggtgctcgatttagtgtgagtagtttggggtttgggggggggggtcctcgagactctcctgtagaggctctggattcaccttttaagtcttatgccatgacctggatcccgccagacgtccgggggaagggactggaggtgggtcgcgaccatcactggaactggaattagtacttactacgcagagtccgtagaagggacggttcaccatctccagagacaactccaggacacttgtttattagacatagaagagcctgcgacactgcggacacggccgtctattctgtgtcaaagccagcgggcgatctacgatccgaacggctattacgtaggtattcgacacgtggggaccacgggaacctggtccaccgtctacctacacgcctaccaacgaacgggtcccagtcccggttaccttccccgtcggaccctacccctccctaccgaacgacgcctaccgtcgtcggggacacgacgccggccgtcgggctcgccgtacggtacgaacgtactaccttccaacgcgttaacgcgttatacggacggcgggctcgggcgaacggcgacagtcgnnnnnga

SEQ ID NO: 173033 - DNA, 585 bp, Homo sapiens
  misc_feature: GYAE6OF01CP6LZ.7.76.G10.1.454.CMB.1.raw
  modified_base (330)..(330): a, c, t, g, unknown or other
  misc_feature (330)..(330): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtatttccatcgggtccgccagactccagacgaaggggctggagtgggtggcagtcatatcaattgatggagacctaattaaaattttagngcggtactccgtagaaacggtcgtattccaccatctacagagacaattccaggaacacacttgtttactgacaatagaacacgccgtagagtaagttgaaggtacgtacgggtaattagtactacgtgtcgacccgtcgacccccgtagacctagtaacgtaaaccggtaccgtacgggtttacccggaccccggttacggggacccgacgggtaaccccgttacgggtaccctacccgtcccgtcccgtacccg

SEQ ID NO: 173034 - DNA, 661 bp, Homo sapiens
  misc_feature: GYAE6OF01BK88E.7.76.G10.1.454.CMB.1.raw
  modified_base (167)..(167): a, c, t, g, unknown or other
  misc_feature (167)..(167): n is a, c, g, or t
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccaggccgtgggacggtccctgacgactctcctgtgcagcctcgtggtacttccaccttcaccttcctatgtactttccgacgtcgggtcccgccagacctccgagaccgaaggggtctgggagtgggtgcagtcagtatctaagttgagtagganacctaaatttaaaatttgcgacggtactcggtagaaccggtntacttccgaccagttcctaccgagacgtaactacttaccgaacggaactacacgtttcgtttacgacgtaactaaagtacgaacgtacggtaccctaggaaacgttaacgttgggaacgtaccgttacgggtaacttaacgtaccgttaacgtcggtacccgtaccccgtaccacccccgttgaaccgtacgaaaccggttaaacccggcgtttaccgggtacccgcccgggtacggacccggtaaccggacccgttccgaccgtacccgtccgtccgtacccgg

SEQ ID NO: 173035 - DNA, 525 bp, Homo sapiens
  misc_feature: GYAE6OF01E2B5N.7.76.G10.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattnatggagccaataaattttangcggactccgtgaacggtcgattcaccatctccagagacaatccaggaacacactgtttctgcaaatgaacagcctgagaattgaggactcgggtaatatactactgtcgcccgtcgaccccctgactgaacgtaaacccggctggttaccgccccgtggggacccacggggtaaccctggtaccacccgttctccctaccg

SEQ ID NO: 173036 - DNA, 655 bp, Homo sapiens
  misc_feature: GYAE6OF01DWQ91.7.76.G10.1.454.CMB.1.raw
  modified_base (300)..(300): a, c, t, g, unknown or other
  misc_feature (300)..(300): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccaggcctggggacggtccctgacgactctcctgtgcagcctctggattccaccttcacttctatgtatttccacgtggtccgccagactcagacgaaggggctggagtgggtgcagtcatancaatgatggagtacctaattaaatttgagcgtactccggtagaacggtcgtacttcaccatctaccgaagaacactaacttaccgaaggaaccactacgttgtttacgtagtaacctaaagttacgaaacacgtacccgtagaacggtaattaggaacgtaaccgttacgggttaattaacgttaacgttaccgttacgttacggtaccccgttaccgtaaccccccgtaggtaccgtaccggtaaacgttaaaacccgggtcgttaccgggttacccggtacccccgggttcggggaacccgtaacggggtaaccccgttcgggtaccctaacccgtcccgttccctaacccgg

SEQ ID NO: 173037 - DNA, 529 bp, Homo sapiens
  misc_feature: GYAE6OF01DIN1A.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcacatctcagagacaattccaggaacacactgtttctgacaatagaacagcctagagtaattggaggacgtcgggtatatactacgtgtcgcccgtcgaccccctgacctgactaaaccggtctacggttccggacccctggggcccgacgggaacccgtcgtaccgaccgtcctccgtaccg

SEQ ID NO: 173038 - DNA, 564 bp, Homo sapiens
  misc_feature: GYAE6OF01CWJIN.7.76.G10.1.454.CMB.1.raw
  modified_base (255)..(255): a, c, t, g, unknown or other
  misc_feature (255)..(255): n is a, c, g, or t
  modified_base (321)..(321): a, c, t, g, unknown or other
  misc_feature (321)..(321): n is a, c, g, or t
  modified_base (393)..(393): a, c, t, g, unknown or other
  misc_feature (393)..(393): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttctatgatttccactgggtccnccagactccagacaaggggctggagtgggtggcagtcatatcaattgatggagccaataaattttngcggactccgtgaacgtcgattcactatctcagagacaattccaggaacacactgtttcagacaaatgaacncgtacctagagtaattggaacggtacgtacgggtaatacttaactacgttagtccgtacccgtcgacccccgtagtaccgtagaacgtaaacccggtacgttcgggttacccggaccccgtcggggacccgacgggtacccctcgggtaccctacccgtctcccgtacccg

SEQ ID NO: 173039 - DNA, 536 bp, Homo sapiens
  misc_feature: GYAE6OF01BF77U.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaattaaaattttatgcggactccgtgaacggtcgattcaccatctccagagacaatccaggaacacacttgtttctgacaaatcgaacagcctagagtaattgaggacgtcgggtaatatactactgtcgcccgtcgacccctgacctgaacgtaaaccggcgttcggttaccgaccccggtgggacccgacgggtaaccctggtcccacccgtctcccgtaccg

SEQ ID NO: 173040 - DNA, 517 bp, Homo sapiens
  misc_feature: GYAE6OF01BDA28.7.76.G10.1.454.CMB.1.raw
  modified_base (256)..(256): a, c, t, g, unknown or other
  misc_feature (256)..(256): n is a, c, g, or t
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccncagctcagacgaaggggctggagtgggtggcagtcatatcaatgatggagctaattaaatttngcgactcgtgaacggtcgatcacatctacagacactaatccagaacacacttgttcngactaatgaacagctagagtatgaggtacgtggtatagtactactgtcgccgtcgacccctgacctgactaaccggtctcggttaccgaccccggtggcccgaacggtaccccgtcggtacccaccggtcctccgtacccg

SEQ ID NO: 173041 - DNA, 562 bp, Homo sapiens
  misc_feature: GYAE6OF01EH6JC.7.76.G10.1.454.CMB.1.raw
  modified_base (255)..(255): a, c, t, g, unknown or other
  misc_feature (255)..(255): n is a, c, g, or t
  modified_base (321)..(321): a, c, t, g, unknown or other
  misc_feature (321)..(321): n is a, c, g, or t
tcagcgtgtctctacacgaccggtgctcgatttagtcactcatacagggagaggctcttctgtgtgtagtggttgtgcagagcctcatgcatcacggagcatgagaagacgttccctgctgccacctgctcttgtccacggtgagcttgctgtagaggaagaaggagccggcgtggtccagcctgggaggtccctgagactctcctgtgcagcctctggattcaccttcacttcctatgatttccactgggtccnccagactccagacaaggggctggagtgggtggcagtcatatcaattgatggagccaataaaatttngcggactcgtagaacggtcgattcacatctccagagacaattaccagaacacacttgtttcagacaaatcgaacagcctagaagtaattaggagtacgtacgggtaatagtactacgtgtcgcccgtacgacccccgtgaaccgtcgaacgttaaacccggtacgttccggttaccggtaccccgtcggggacccgacggggtaacccctcgggtacccacccggttccgtcccgtacccg

SEQ ID NO: 173042 - DNA, 781 bp, Homo sapiens
  misc_feature: GYAE6OF01CLY03.7.76.G10.1.454.CMB.1.raw
  modified_base (165)..(165): a, c, t, g, unknown or other
  misc_feature (165)..(165): n is a, c, g, or t
tcagcgtgtctctacacgaccggtgctcgatttagtcactcatacagggagaggctcttctgtgtgtagtggttgtgcagagcctcatgcatcacggagcatgagaagacgttccctgctgccacctgctctgtccacggtgagcttgctgtagaggaagaaggngccggcgtggtccagccgtgggacggtccctgagactctcctgtgcagcctctgtattccaccttcacttcctatgtactttccgacgtcgggtccgccagacctccgaacgacggaaggggctggggacggtgggtcggcgagtcaatagtactaagttgagtaggacgtacctaaatttaaaacttttagacgtacggtaccgttccgtacggtaaacggttccgtaattccctaaccgtacttacccgttacccgaaaggtaacgtaaccgttaaacgtttacccgaaacgggtaaacctaccttaaccgtttacggttttaccacggtaaacctaaagttaccgaaacgtaaccgtacctaggtaaagttaagttacgggtaacgggtacgtttaacgggttaattaacgttaaccgttaacggttcggttacccgtaccccggttacccgtaacccccgtaggtacccgtaaacggtaaaccgttaaacccgggtaccggtttaccggggttacccccggaacccccggggttgggggaacccccgtaaacgggggttaacccccgttacggggtaccccctaccccggtttcccgtccccgttaacccgg

SEQ ID NO: 173043 - DNA, 735 bp, Homo sapiens
  misc_feature: GYAE6OF01CPH38.7.76.G10.1.454.CMB.1.raw
  modified_base (343)..(343): a, c, t, g, unknown or other
  misc_feature (343)..(343): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacggtccctgagacctctcctgtgcacgcctctggacttccacctttcaccttcctatcgatttccacgtcggtccgccagacctccagacgaaggggctgggagtgggtgctagcatatctaattgatggaacgacctaatttaaaattttgnggtacggtacttacccggtaggaacggttcgacttcacccactcctaccaagagactaacttcccaaggtaaccactacttgtttcagtaaccaaatacggaacctacggtccctaggtaacgtaaagttacgggaacgggttaccggttaacggggttaattaacgttaaacccgtttacgtaccggttaccgttacccccggttacccgtaaccccccggttaggtaaccgttaccggaacccggttaaaacccgggttaccgggttacccgggttaaccccgggtaaccccccggggttcgggggaacccccggtaaaccggggtaaccccccggtttacggggtacccccgttaaacccccggttcccgttaccccgttaacccccgg

SEQ ID NO: 173044 - DNA, 835 bp, Homo sapiens
  misc_feature: GYAE6OF01BW4DY.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccactgctcttgtccacggtgagcttgctgtagaggaagaaggagccggcgtggtccagccgtgggacgtccctgagactctccgtgtgcagcctcgtggacttcctaccttcaccttcctatgtactttccacgtcgggtcccgccacgacctccgagacgaagggggctgggaggtgggtggctagtacagttatactaagttgagttacggaacgtacctaaaatttaaaaatttttgacggtaccggtaccgttaccggtacggtaaaccgggtccgtaacttcccgaaacctacttacctacccgaaggtaaccgtaaacctaaccgtttacccgaaacgggtaaaccctaaccttaaccgtttacgttttaccttacggtaacctaaaacgtacgtaaacgtacggtaccctaaggtaacgtaacgtttaacgggtaacgggttaaccggtttaacggggttaactttaaacccgtttaaccgttaacccggttacggttaccccggtacccccgggttacccgttaacccccccggttaggtaacccgttaacgggttaaaacccgttaaaaccccggggtaccggtttacccggggttaccccggtaacccccgggtaccgggggtaaccccggtaaacccgggggtaaccccggttaccgggttacccccggtaaccccggttcccgttcccccgtaaccccgg

SEQ ID NO: 173045 - DNA, 541 bp, Homo sapiens
  misc_feature: GYAE6OF01BFN74.7.76.G10.1.454.CMB.1.raw
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (524)..(524): a, c, t, g, unknown or other
  misc_feature (524)..(524): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggagtccctgagactctcctgtgcagcctctggattcaccttcaccttcctatgtatttccacgtcgggtccgccagacctccagacgaaggggctggaggtgggtggcagtcatatcaattgatggagcctaataaatttngcgactcgagacgtcgatcacatctcaganacactcagaacactacttgttcagacaatcgaacacgcctagagtattagagtacgtacggtaatagtactacgtgtccgtacccgtcgacccctagtactacgaacgtaaaccggtcgttacgtacccggcccgtcgggacccaacgggtaccctcggtacccnccgttcctccgtacccg

SEQ ID NO: 173046 - DNA, 801 bp, Homo sapiens
  misc_feature: GYAE6OF01COHD8.7.76.G10.1.454.CMB.1.raw
  modified_base (168)..(168): a, c, t, g, unknown or other
  misc_feature (168)..(168): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggngccggcgtggtccagccgtgggacgtccctgacgctctccgtgtgcacgtcctcgtggtacttccacctttctaccttctatgtacttttcccgacgttcgggtcccaccacgacctaccgaggacgaaggggctgggaggttgggtggctagtcatatactaattgagtggactacgttaaatttaaaacgttttgacggtaccggtaccgttaccggtaacggtaacggttccgtaacgtttacccaccttaacgtccgtaaccgaaaggtacgtaaacctaacgtttaccgaaacgggtaaccaaccgttacgtttacgttttacctagtaaacctaaaaggttcgaaaacccgcgttaacccgtaggaaaccggttaagttacgggtaaacggtaaccggtttacgggttaaatttaaccgttaaccgttaccggttacgggtccccggttacccccgggttacccgtaaccccccggttgtaacccggttaacggaaacccggttaaaaccccggggtttccgggtacccggggtttaaccccgggcccccgggttagggggacccccgaaacccggggttaccccgtacgggttaccccgtaacccctcccggttcccctaacccgg

SEQ ID NO: 173047 - DNA, 565 bp, Homo sapiens
  misc_feature: GYAE6OF01BCO8X.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggacttcaccttcacttcctatgatttccactgggtccgccagactccagacgaaggggctggagtgggtggcagtcatatcaattgatggagacctaattaaaattttatgcggactccggtagaacggtcgaacttcacctatctaccagacgacaacttccaaggaacactacttgttactgactaaatacgaacacgacctagaagtaagttggaaggtacgtacgggtaatactacgtactcgtcgtcccgtcgacccctgactacgaacgtaaaccggcgtaggttacccgaccccgtcggggacccgacgggtaccctcggtaccaccgtctcccgtacg

SEQ ID NO: 173048 - DNA, 546 bp, Homo sapiens
  misc_feature: GYAE6OF01E4FLB.7.76.G10.1.454.CMB.1.raw
  modified_base (258)..(258): a, c, t, g, unknown or other
  misc_feature (258)..(258): n is a, c, g, or t
  modified_base (329)..(329): a, c, t, g, unknown or other
  misc_feature (329)..(329): n is a, c, g, or t
  modified_base (396)..(396): a, c, t, g, unknown or other
  misc_feature (396)..(396): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccaggcctggggaggtccctgagactctcctgtgcagcctctggattcaccttcacttcctatgatttccactgggtccnccagactccagacgaagggctggagtggtggcagtcatatcaattgatggagacctaattaaaattttagngcggactccgtgaacggtcgattcaccatctccagacgactaacttccaaggaacacacttgtttcngacaaatgaacagccctagagtaattggaggacgtcgggtaatatactactgtcgcccgtacgacccctgacctgaacgtaaaccggcgttacggtaccgaccccgtggggacccaacgggaccccgtggaccaccgtccgtccgtaccg

SEQ ID NO: 173049 - DNA, 522 bp, Homo sapiens
  misc_feature: GYAE6OF01BHTAB.7.76.G10.1.454.CMB.1.raw
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (510)..(510): a, c, t, g, unknown or other
  misc_feature (510)..(510): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtactttccactgggtccnccagacctccagacgaaggggctggagtgggtggcagtcatatcaattgatggagcctaattaaatttngcgactccgtagaacggtcattccacatctcaganacaatccagaacacacttgttctgacaatcaacacgcctagagtaattgagtacgtacggtatactactactgtcgcccgtacgacccctgactagacctaaccggctcggttaccgcccgtcgggccgacgggtaccctcggtaccnccgtctcctccg

SEQ ID NO: 173050 - DNA, 560 bp, Homo sapiens
  misc_feature: GYAE6OF01B6PZ4.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctctggattcacccttcacttcctatgatttccactgggtccgccagactccagacaaggggctggaggtgggtggcagtcatatcaattgatggagccaattaaaattttatgacggactccgtgaacggtcgattcacactctccagagactaacttaccgaagaacactacttgtttctgacaaatgaaacagcctagaacgtaattagaaggacgttacgggtaattactacttacgtgtcgcccgtcgaccccctgacctgaactaaaccggtacgttcggttaccggaccccgtcggggcccgaacgggtacccgtcggtacccacccgtcctccgtaccg

SEQ ID NO: 173051 - DNA, 600 bp, Homo sapiens
  misc_feature: GYAE6OF01AL0HT.7.76.G10.1.454.CMB.1.raw
  modified_base (167)..(167): a, c, t, g, unknown or other
  misc_feature (167)..(167): n is a, c, g, or t
  modified_base (336)..(336): a, c, t, g, unknown or other
  misc_feature (336)..(336): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagccgtggggacggtccctgagactctcctgtgcagcctctggattcaccttcacttcctatgtactttccacgtcgggtccgccagacctccagacgaaggggctgggaggtgggtggcagtcatatcaattgatggagaccaattaaatttagngcggactccggtagaaccggtcgattccacctatcctaccaagacgaactaacttccgaacggaacactacttgtttacagaacaaatcgaaactagccgtagaacgtaagttggaacggtacgtagggtaattaacgtactacgtcgtcgacccgtacgacccctagacctaggaacgtaaacccggtcgttcgggttacccggaccccggtggggacccgaccggggtaacccgtcggaccctcccggttcctcccgtcccg

SEQ ID NO: 173052 - DNA, 553 bp, Homo sapiens
  misc_feature: GYAE6OF01BCVZL.7.76.G10.1.454.CMB.1.raw
  modified_base (258)..(258): a, c, t, g, unknown or other
  misc_feature (258)..(258): n is a, c, g, or t
  modified_base (329)..(329): a, c, t, g, unknown or other
  misc_feature (329)..(329): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgactttccacgtgggtccnccagacctccagacgaaggggctggaggtgggtggcagtcatatcaattgatggagcctaattaaatttanggcgtactcggtagacggtcgattcaccatctccagacgactactccgaggaaccactacttgtttctagactaaatgaacacgcctagaagtatggacgtacgtcgggtatactactacgtcgtcgcccgtcaccccgtgacctgaacgtaaccggcgttcggtacccgaccccggtcgggacccgtacgggtaccctcggtaccaccgtccgtccgtacccg

SEQ ID NO: 173053 - DNA, 737 bp, Homo sapiens
  misc_feature: GYAE6OF01COK93.7.76.G10.1.454.CMB.1.raw
  modified_base (263)..(263): a, c, t, g, unknown or other
  misc_feature (263)..(263): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccagccgtgggacgtccctgacgctctcctgtgcagcctgtggtacttccaccttcacttcctatcgtactttccacgtcggtccncctacgacctaccgagacggaaggggtcgtaggtaggtgggtcggacgtagtactaattactactaagttgagtggaacgtacctaaatttaaaagttttcgacggtaccggtaccttaccggtaaggtaaccggtcgtaacttacctaacctacttcctaaccgaaacgtaacgtaacctaaacgttaccgaaacggtaaaccaaccgttacgtttacgtttaccgttacgaaactaaacgtacgtaaaccgtacgtaccgtaagaaggtaaagtttagggaaaccggttaacggttacgggtaacttaacgttaaccgtacgttacggttacccgaccccgttaccgaccccgttagtaccgtacgtaaaccgtaaacccggtacggttaccgggttacccgtaccccgggtacggggacccgtaaccgggtacccgttacggtacccgtacccgttccgtacccgtacccg

SEQ ID NO: 173054 - DNA, 795 bp, Homo sapiens
  misc_feature: GYAE6OF01C4SCJ.7.76.G10.1.454.CMB.1.raw
  modified_base (265)..(265): a, c, t, g, unknown or other
  misc_feature (265)..(265): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctcctcttgtccacggtgagcttgctgtagaggaagaggagccggcgtggtccagccgtggggaggtccctgagactctcctgtgcagcctcgtggacttccaccttcactttcctatgtactttccacgtgggtcccnccagacctccaagacgaaggggctggaggtgggtggcagtcatatacaattgagtaggagacctaaatttaaaaattttagtacggacggtaaccgttccggtaggtaaaccgggtcgtaactttaccaacccctattaccctacccgaaaggtaacgaacccttaaacttacccgtaaacgggaaaccctaaccgtaacgtttacgttttacctacggaaactaaaacgtacgaaaccgtacgtacccgttaaggaacgtaaagtttacgggaacgggtaaccgtttacggggttaaattaacgtttaaccgttaaccgttacggtaccggtacccccggttaccggtaccccccgttaggtaacccgtaaccggtaaaccggttaaaacccgggtaccggtttacccggggttaaccccgggtaacccccgggttcggggggaaccccggtaaaccggggttaaacccccggttaccgggttaaccccgttacccccggttcccttacccgtcccggtaacccccggg

SEQ ID NO: 173055 - DNA, 742 bp, Homo sapiens
  misc_feature: GYAE6OF01C05SI.7.76.G10.1.454.CMB.1.raw
  modified_base (272)..(272): a, c, t, g, unknown or other
  misc_feature (272)..(272): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggcgccggcgtgtccagccgtgggacgtccctgacgactctcctgtcgcacgtcctcgtggtacttccacctttctacttcctatcgtactttccgacgtcggtccnccacgacctccgaagaacggaaggggtcgtagggacggtggggtcggactaggtctaagttactactaagtttgagtggaacgtacctaaaatttaaaacgtttgtacggaccggtactaccggtacggtaacggttacgtacttaccactactacctaccgtaagacgtaactaacgttacccgaaacggtaacaactacgtttgtttacacgtaacctaaagtcgaaactacgtaccgtaggtaacgttaacgttacggaacgggttaaccgttacgggttaaattacgttaaccgttacgtacggttacccggtaccccggttacccgtaccccgttaggtaccgtaacgtaaaccggtaaacccggttccggttacccggttaccccggaccccgggtacggggaaccccgtaaccgggtacccgttaccggttaccccgtaccccgttccgtcccgtaaccccgg

SEQ ID NO: 173056 - DNA, 790 bp, Homo sapiens
  misc_feature: GYAE6OF01A2B4Q.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccagccgtggggacggtccctgagactcctcctgtgacacgcctcgtggacttcctacccttcacctttcctatgtacttttccacgttcgggtccgccaacgacctaccgaggaccggaacgggggcgttaggggagggttggggtcggcgtaggttaccaattacttactaaagtttggaagtacgggtaacgtaacccttaaaagtttaaaaatttttacgtaggtacccgggtaccgttacccggttaggtaaaccggttaccggtaactttacccgaacccttaacgttccccgttaaccgaaacggtaacgtaaaccgttaaacgtttacccggaaaaccgggtaaacctaaccgttaaccgttttacgttttaccgtagtaaactaaaacgtacggtaaaccgtagttacgtaagtaaggtaaacgttaggtaacgggtacgttaacgggttaattacgttaaccgttacgttcgtccgtaccccgttaccgacccccgttagaccgtacgtaaaccgtaaacccggtccggttacggtaccccggtacccggtacggggacctaccgggtaacccgtcggtaccctaccgttccgtccgtacccg

SEQ ID NO: 173057 - DNA, 554 bp, Homo sapiens
  misc_feature: GYAE6OF01EPHYV.7.76.G10.1.454.CMB.1.raw
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactggtcccgcagactccagacaaggggctggaggtgggtggcagtcatatcaattgatggagccaataaattttangcggactcgtgaacggtcgattcaccatctccagacgacaattccagaacacacttgtttcngacaaatcgaacacgcctagagtaattggacgtacgtcgggtaatataactacgtcgtcgtcccgtacgaccccctgtacctacgaacgtaaacccggcttacgggttcccgaccccggtacggggacccgacgggtaccctcggtacccacccgttccgtccctaccg

SEQ ID NO: 173058 - DNA, 686 bp, Homo sapiens
  misc_feature: GYAE6OF01B3AUJ.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgcagactccagacaaggggctggagtgggtggcagtcatactcaattgatggacgtacctaaattaaaattttagtggacggtaccttccggtaggaacggttcgtaacttacaaccctattcctaccaggaacgaactaacttcccgaaacggaaccaactaccgttacgttttctacggactaaaatacggaaaccaacggtaccctaggaacggtaaagttaggaacgggtaaccgttacgggtaaacttaacgttaaccgttaacgtcggttaccgccccggttacgacccccctagtaccttacggtaaaccgtaaacccgggttaccgttaccgggttacccggtaccccccggtgggggaaccccgaaccggggtaaccccggttacgggtaccccgtaccccggttccgtcccgttaacccgg

SEQ ID NO: 173059 - DNA, 769 bp, Homo sapiens
  misc_feature: GYAE6OF01BRSFD.7.76.G10.1.454.CMB.1.raw
  modified_base (177)..(177): a, c, t, g, unknown or other
  misc_feature (177)..(177): n is a, c, g, or t
tcagcgtgtctctacacgaccggtgctcgatttagtcactcatacagggaggaggctcttctgtgtcgtagtggttgtgcagagcctcatgcatcacggagcatgagaacgtaccgttcccctgctgccacctgctcttgtccacggtgagcttgctgtagaggaagaggagccggngtggtccagccgtgggacgtccctgacgactctcctgtcgacacgtcctcgtggtacttcctacctttcacctttcctattgtactttcccgacgttcgggtcccaccgacgtaccctaccgaacggtaacggtaacgggggtcctagggggtaacgggttcggggtacggaccgtaacggttacctaagtttaacgtactaagtttaggaagtcgggtaactaccgtaaaatttaaaagttttcgacggtaccggtacgttaccggtaagtaccggtacgtaacttaccgacctacgttcctacgaagtacgtaacctaacgttaccgaaacggtaacctaacgttactttacgttactacgtaaactaaagtaccgtaaactcgtacccgtaaggtaacgtaacggttacggaaaccggttacggttacggttaacttaacgtaccgttacgttaccggtacccgtaccccgtaccgtaccccgtaggtaaccgtacggtaaaccgttaaccggtacggttccggtacccggtccggtacggaacccggtaccggtacccttcggtaccctaccgttcccgtccgtaccg

SEQ ID NO: 173060 - DNA, 594 bp, Homo sapiens
  misc_feature: GYAE6OF01C8NLQ.7.76.G10.1.454.CMB.1.raw
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctcgtggattcaccttcacttcctatgactttccacgtcggtccgccagactccagacgaaggggctggagtgggtgcagtcatatcaattgatggagaccaattaaatttagngcgactcgtagacgtcgattcacatctacagacgtacaacttaccacggaacactacttcgtttcataacaaatacgaacacgtcctagaacgtataggacggtacgtacggtaacttaacgttactacgtcgtcgtcccgtccgtaccccctagtacctacgtaacgtaaacccggtacgttaccgggttacccgaccccgggtacggggaccccgtaacggggtaaccccttacgggtaccctacccgtccgtcccgtacccgg

SEQ ID NO: 173061 - DNA, 671 bp, Homo sapiens
  misc_feature: GYAE6OF01BBLX0.7.76.G10.1.454.CMB.1.raw
  modified_base (265)..(265): a, c, t, g, unknown or other
  misc_feature (265)..(265): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggacgtccctgagactctcctgtgcagcctgtggacttccacctttcacttcctatcgtactttccacgtcgggtccnccagcctcagacgagggctggagtgggtgctagtcatatactaagttgagtggactacctaaattaaaatttgcgtacgacttccggtagtaaccggtcgtattaccactatcctaccgaagacgtaactaacttaccgaagaacctactacgttacttacgtacgtaactaaactacgaaccgtacgtaccctagaacggtaattaacgggacgggtacgttaacgggttaacttaacgttaaccgttacgttaccggttacccgtccccggtaccgtaacccccgtaggtaaccgtacggtaaaccgttaaacccggtcggtttacgggttacccccggacccggtacggggaccccgtaaccgggtacccgttcggtacccgacccgttccgtcccgtacccg

SEQ ID NO: 173062 - DNA, 838 bp, Homo sapiens
  misc_feature: GYAE6OF01DNTQY.7.76.G10.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccaggtgagcttgctgtagaggaagaggngccggngtggtccagccgtgggacgtccctgagactctcctgtcgcacgtcctcgtggacttccaccttcaccttcctatgtactttccacgtcgggtccaccagacctccgagacggaaggggtcgtgggaggtggggtgacgagtacaattatactaattgagtaggaactacctaaatttaaaactttgtacggaccggtaccgtaccggtacggtaacggttctacgttaccacctactacctaccgaagaacgtaacctaacttacccgaaggaaccctacgttaccgtttagtttacccaagtaactaaaacgttacggaacctaacggtaccctaagggtaaacgttaaagtttacgggaaccggggtttaacgtttaaccgggggttaattaacccgtttaaccggttaacccggttacgggttaccccgggtccccccggttaaccggtacccccccgttaaggtaaaccgttaaacccgggttaaaacccggtaaaacccggggtttcccgggtttaaccccggggtttacccccggggtaaacccccccgggttacgggggggttaaacccccgggaaaaccccgggggtttaacccccgggtttacccggtaacccccggtttccccccgggtttacccttacccccggtaaaccccgg

SEQ ID NO: 173063 - DNA, 532 bp, Homo sapiens
  misc_feature: GYAE6OF01AT34K.7.76.G10.1.454.CMB.1.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggacttcacctttcacttcctatgatttccacgtgggtccnccagactccagacgaagggctggagtggtgcagtcatatcaattgatgganccaattaaatttngcgactccgtagaacggtcattcacatctccagacgacaatcagaacacactgttcagacaaatgaacagctagagtaatgacggtacgtcggtatactactactgtcgcccgtcgaccccgtgacgtacgtaactaaccggtcgttcggtacccgccccggtcgggaccctacgggtaccctcggtacccacccgtccgtccgtaccg

SEQ ID NO: 173064 - DNA, 685 bp, Homo sapiens
  misc_feature: GYAE6OF01B17G8.7.76.G10.1.454.CMB.1.raw
  modified_base (269)..(269): a, c, t, g, unknown or other
  misc_feature (269)..(269): n is a, c, g, or t
  modified_base (593)..(593): a, c, t, g, unknown or other
  misc_feature (593)..(593): n is a, c, g, or t
  modified_base (600)..(600): a, c, t, g, unknown or other
  misc_feature (600)..(600): n is a, c, g, or t
  modified_base (674)..(674): a, c, t, g, unknown or other
  misc_feature (674)..(674): n is a, c, g, or t
tcagcgtgtctctacacgaccggtgctcgatttagtcactcatacagggagaggctcttctgtgtgtagtggttgtgcagagcctcatgcatcacggagcatgagaagaccgttccctgctgccacctgctcttgccgaggtgagtcttgctggagaggaagaaggcgccggcgtgtccaggccgtgggacgtccaggactctctcgtgacgcacgtcctgtgtacttccaccttctacttctatcgtacttccgacgttcgggacccnctacgacctaccgaaggacggaagggggtcgtagggaggtgggtacgacctagtacattatagtaagttgagtacggaactaactaaaatttaaacgtttgacggaccggtactccggtaaggtaccggtactacttacccgacttacgtaccgtaaccgaagtaaccgtaactacgtaaccgaaaggtaacccttaacgttacgtttacgtttaccgaacgaaactaaacgtaccgaaacgtacgtaccgttaaaggaaacggttacgttaaggaccgttaacggtggttaactacgtactacgtcgtaccgtacccgtaccncccgtanaccgtaggtaaaccgtaccggtcgtacgggtaccccgcggtaccgggaccgtaccggtaccgtcggacctcccnccgtctacccg

SEQ ID NO: 173065 - DNA, 522 bp, Homo sapiens
  misc_feature: GYAE6OF01DIEBF.7.76.G10.1.454.CMB.1.raw
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (358)..(359): a, c, t, g, unknown or other
  misc_feature (358)..(359): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (435)..(435): a, c, t, g, unknown or other
  misc_feature (435)..(435): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacggtccctgagactctcctgtgcagcctctggattccaccttcacttcctatgtatttccactcgggtccgccagactccagacgaaggggctggagtgggtggcagtcatatcaattgatggagctaataaatttngcgtactcgtagacgtgattcacntctcngannaatccagacacatgttcngacaatgacngcctagagtatgagtcgtgtatatctacgtcgtcgtccgtcacccctntacgtacgacgtaaccggtcgtcgggttacccggcccgtcggggacccgacgggtacccttcggtaccctaccgtccgtcctacccg

SEQ ID NO: 173066 - DNA, 904 bp, Homo sapiens
  misc_feature: GYAE6OF01AYNOC.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggagtccctgacgactctcctgtgcagcctctggacttccacctttcacttcctatcgtacttttcccgaacgttcggggtcccctacccgaacgtacccgttaccccgaacgggaaccggtaaacggggggtccttagggggtaacggggttcgggggttacggggccctaagggttcctaaacgtttaactaccgtaaaacgttttcggaagtttacggggaacgttaaccccgtaaaagttttaaaaacgttttttacggtacggggtacccggggttaacccgtttaccccggggttaagggtaaacccggggttttaccgtaaaccgtttttaccccgaaaacccgtaccgtttaccccgttaacccgaaaacgggtaacgtaaacccgttaaaccgtttacccggaaacgggtaaaccctaaccgttaaccgttttacgtttaccgttacggtaacctaaaacgttaccgtaaaccgtacgtacccgtaggtaaaccggttaaagtttacggaacgggtaacgttacgggtaattacgttaaccgttaacgtcggttaccgcccggttaccgacccccgttagtaacccgtacggtaaaccggttaaacccggtacgttacccgggttacccggtaaccccgggttcggggaaccccggtaccgggtaaaccccgttcggtaacccgacccggttcccgtcccgttacccg

SEQ ID NO: 173067 - DNA, 590 bp, Homo sapiens
  misc_feature: GYAE6OF01D8M7J.7.76.G10.1.454.CMB.1.raw
  modified_base (243)..(243): a, c, t, g, unknown or other
  misc_feature (243)..(243): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtcggtccagcctgggacgtccctgagactctcctgtgcagcctctggacttccaccttcacttcctatnactttccacgtgggtccgccagacctccagacgaaggggcctggaggtgggtggcgagtcattatcaattgatgganccaataaatttngcgactccgagaacggtcattcactatctaccanagtacaattccaagaacactacgttgtttcgagacaaatcgaaactagtcccgttaagacgtaattcggaacgggtacgtacgggttaattactaaccgttacgttcggtccgtaccccgtacgtaccccctgaccgtacgtaacgtaaaccggtcgttaccgggttaccggacccccgtggggacccgacgggtaccgtcggtaccgtactccgtcttccccg

SEQ ID NO: 173068 - DNA, 686 bp, Homo sapiens
  misc_feature: GYAE6OF01EGKCY.7.76.G10.1.454.CMB.1.raw
  modified_base (177)..(177): a, c, t, g, unknown or other
  misc_feature (177)..(177): n is a, c, g, or t
  modified_base (274)..(274): a, c, t, g, unknown or other
  misc_feature (274)..(274): n is a, c, g, or t
  modified_base (467)..(467): a, c, t, g, unknown or other
  misc_feature (467)..(467): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagtcttgctgtagaaggaaggaaggcgccggngtggtccagccgtgggacgtcctagagtcctctccgtgcgcacgtcctctggtacttcctacctttctacttcctatgtactttccacgtcggtccncagacctcaagacgagggcgtggaggtgggtcgcagtcagtatactaattgagtacggactactaaatttaaagtttcgcggaccgtacgttcggtagtaaccggttactactaccactactaccgtacagaacgtactaacgtaccgaacgaacctacttacgtttagttacacgtaacaaacgtacgaacncgtacgtaggaacgttagtaacggtacgttaacggttacggttaatacttaacgttacgttacgttcccggaccccgtacctaaccccgtgtaaccgttacgtaaaccggttaacccgtacgttcccggggttaccccggtaaccccgggtaccggggtacccggtaaaccggggtcccggttacgggtaccccgttccccgtcgtccccggtaacccg

SEQ ID NO: 173069 - DNA, 707 bp, Homo sapiens
  misc_feature: GYAE6OF01BR5ES.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacgtccctgagactctcctgtgcagcctctgattcaccttcacttcctatgtactttccacgtcggtccgccagtacctccagacggaaggggccgtgggaggtgggtcggcaggtctaatatactaattgagtggacgtacctaaattaaaattttgtcgacggtaccgtaccgtaggtaaccggtcgtaacttacccaacctacttaccacccgtaaggaacgtaacctaaacgttacccgaaacggtaacctaacccgttactttcggttttacctacggtaaacctaaaagttaccgaaaccgtacggtacccgtaaggaacgttaacgtttacgggaacggttaaccggttacgggtaatttaacgtaacctttaacgtcggttaccgtccccgtacccgtaccccgttagtaaccgttacgtaaaccggtaacccggtacgttccgggttaacccggccccggtacgggacccgaacggtaccccgtggtaccctcccgtcctccgtacccg

SEQ ID NO: 173070 - DNA, 677 bp, Homo sapiens
  misc_feature: GYAE6OF01AQOR9.7.76.G10.1.454.CMB.1.raw
  modified_base (118)..(118): a, c, t, g, unknown or other
  misc_feature (118)..(118): n is a, c, g, or t
  modified_base (393)..(393): a, c, t, g, unknown or other
  misc_feature (393)..(393): n is a, c, g, or t
tcagcgtgtctctacacgaccggtgctcgatttagtcactcatacagggagaggctcttctggtgtgtagtggttgtgcagagcctcatgcatcacggagcatgagaagacgttcccngctgccacctgcctcttcgtccacggtgagcttgctgtagaggaagaaggagccggcgttggtccaggcccgtggggacggtccctgacgacctcgtcgtgtgccagcctgtgtacttccacctttcacttcctagtgtactttccacgtcgggtcccgccacgtacctccgagacgaaggggctaggagtggtgctagtcatacataatgatggtacgactaattaaatttagcggtacgtacgtccggtacggaacgtcgaattaccaccgtnttcctccaagacgaactacgtaccaaggaaccactacgttgtttacgtacgtaacgtaaacgtacgtaaccgtacgtaccgtaaggaacggtaacgttacgggtaaccggtcgggttaacggttaacgttaacgtaaccgttacgttcggtaccgtaccccggttaccgaccccgttagtaccgtacgtaaaccggtaaccggtaccgttccggttacccggtacccggtccgggtcccgaaccgggtacccgttcggacccgtacccgtccgtcccgtacccg

SEQ ID NO: 173071 - DNA, 713 bp, Homo sapiens
  misc_feature: GYAE6OF01EF0AL.7.76.G10.1.454.CMB.1.raw
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
tcagcgtgtctctacacgaccggtgctcgatttagtcactcatacagggagaggctcttctgtgtgtagtggttgtgcagagcctcatgcatcacggagcatgagaacgaccgttcccctgctcgcccacctgcttcttgtccacggtgagcttgctgtagaggagaggngcgngtgtcagcgtggcgtcctgagctctctgtgcacgcctgtgacttcctaccttcacttcctatcgtactttccgacgtcggtcccnccagacctaccgagacggaacgggcgtggaggttgggtgacgngtactatactactaagttgagtggaaccgtaacttaaatttaaagttttagcggtacggtacttacccggtaggtaaccggtactacgttaccaacctacttacccgtaccaagtaaccgtaacctaactttacccggaacgaacctacttaacgtttcgtttactacgtaactaaacgtacgtaaccgacgtaccgtaaggtaacgttaagttagggacggttacgttaccgggttaattaaccgttacgttaccgttacggtcccgtaccccgttaccgtacccccgttagtaccgtaaccggtaaaccgtaacccgggtaccgttaccgggttaccccggacccggtaccgggacccggtaacccgggtacccgttccggtaccccttcccgttccctcccgtacccg

SEQ ID NO: 173072 - DNA, 723 bp, Homo sapiens
  misc_feature: GYAE6OF01EAQXF.7.76.G10.1.454.CMB.1.raw
  modified_base (173)..(173): a, c, t, g, unknown or other
  misc_feature (173)..(173): n is a, c, g, or t
  modified_base (259)..(259): a, c, t, g, unknown or other
  misc_feature (259)..(259): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagcctgggaggtccctgagactctcctgtgcagcctctggattccaccttcacttcctatgactttccactgggtcccncagacctccagacgaaggggctgggaggtggggtggctagtcattatctaattgatggacgtacctaattaaaattttagcggtacggtacctaccggtagaacggtctagttacaccctatcctaccgaagacgtaactaacttacccgaaggaaccaacgtaacgtttcgttttacctaggaactaaaacgtacgtaaaccaggtacccctaggaaagtaaacgtttacgggaaacgggtaccggttaacggggttaactttaactaacccgttaacgttcggttccgacccccggttaccgtaaccccctaggtaacccgttaggtaaacccgttaaaacccgggtaccgtttaccggggttaaccccggaaccccccggggttacggggaacccccgtaaaccgggggtaaccccccttaggggtacccccttaacccgggtcccttaccccggtacccg

SEQ ID NO: 173073 - DNA, 740 bp, Homo sapiens
  misc_feature: GYAE6OF01ETMLG.7.76.G10.1.454.CMB.1.raw
  modified_base (341)..(341): a, c, t, g, unknown or other
  misc_feature (341)..(341): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacggtccctgagactctcctgtgcagcctctggacttccaccttcacttcctatgtactttccactggtcccgccagacctccagacgaaggggctggaggtgggtggcagtcatatactaattgagtggacgtacctaattaaaacttttancggcgtacgtccggtagtaacggtcgtactacaccatcctaccagacgactaacttccgaacggaaaccacgtaactttcgtttacgtacgtaactaaaacgtacggaaaccacggtacccttaaggaaacggttaaacggtttacgggaacggggttaaccgttccgggggttaaactttaaccgttaacctttaacggttaccggttcccgggtacccccggttacccggtaacccccccgttaggtaacccgttaacggaaaccggttaaaaccccgggtaccggtttacccgggttaccccggtacccccgggttaccgggggtaccccgaacccgggggttaaccccgttaccgggttacccccgaaccccggtttcccgtcccgtaccccggg

SEQ ID NO: 173074 - DNA, 755 bp, Homo sapiens
  misc_feature: GYAE6OF01APW4R.7.76.G10.1.454.CMB.1.raw
tcagcgtgtctctacacgaccggtgctcgatttagtcactcatacaggagaggctcttctgtgtgtagtggttgtgcagagcctcatgcatcacggagcatgagaagacgttccctgctgcccactgctcttgtccacggtgagtcttgctgtagaggaagaggacgccggcgtggtcccagccgtggggacgtcccgtgacgacctcgtcctggtgcacgtcctcgtggtacttccaccttctaccgttcctatcgtacttcctacgtcggtcccacctacgcctaccagaccggacggggctcgggaggtgggtcggcctaggtcaagttacgtacgtaagttggtaacgtggtaacgtacccttaaaagttttaaaaagtttcgtccggggtaaccgaccggttacccggttaacgggtaaaaccgggtttctaaacggtttcccaaccgttaaaccgttccccgtaccgaaaggttaacctaacgtaaaccgtttaccgaaacgtaaccgtaacctacgtttacgtttacgtactaaccgtaaacgtacgaactaacgtacgtacgaataacgttaggacgtaacgtaccggtaataacgtacgttacgttacgtacgtaccccggtacgtaccccgtacgtacctacggtaaaccgtaccgggtacgttacccggtccggtaccccgggacgggttaccccggaaccggttccggtaccggttacccgtaccgtcccgttccgtacccgg

SEQ ID NO: 173075 - DNA, 733 bp, Homo sapiens
  misc_feature: GYAE6OF01D4Q06.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgccacctgcttcttgtccacggtgagtcttgctgtagaggaagaaggcgccggcgtcggtccagcgtgggacgtccctgacgactcctcctgtgcacgcctgtgtacttcctacctttcaccttcctatcgtactttccgacgttcggtccaccgacgtacctccgaagtaacggaacggggtcgtagggaggtgggtcggctaggtactattactacgtagttagagtacggaactacctaaatttaaacgtttcgcgtaccggtactaccggtacggtaacggtactacgtacaccgtacgtactaccgaagaacgtaacaacttaaccgaacgtaacctaacgttactttacgttaccgtaacgtaactaaacgtaacgtacgacgtaccgtaaggtaacgttaacggttacggacggttaacggttacggttaataaccgttaaccgttacgttaccggtacccgttacccggtaccgtaaccccgtagtaacccgttaacggaaacccgttaaccggtacggttacccgggtaccccggtacccgggaccgggtaacccggtaacccgggtcctacgggtacccgtacccttcccgtcgtacccgg

SEQ ID NO: 173076 - DNA, 691 bp, Homo sapiens
  misc_feature: GYAE6OF01AVG4C.7.76.G10.1.454.CMB.1.raw
  modified_base (171)..(171): a, c, t, g, unknown or other
  misc_feature (171)..(171): n is a, c, g, or t
  modified_base (263)..(263): a, c, t, g, unknown or other
  misc_feature (263)..(263): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgccacggtgagcttgctgtagaggaagaggagccggngtggtccagccgtgggacgtccctgagctctcgtgtgcagtcctcgtggacttccaccttcacttcctatcgtactttccacgtcgggtccnccacgacctcgagacgaagggctgggaggtggcggcacgtcatatcaagttgagtgganactaaagtttaaatttgngaccggtactcggtagaacggttctatccactactctacgaagacgtaactacgttaccaacggaacctactacgtttggtttacctaggtaacctaaaagtacgaaacgtaccgtacctaaggtaacgtaaacgtttggaaccgggttacgttacgggttaatacgtttaaccttacgggttacgttacccggtccccggtaccgtaacccccgtaggtaacctaaccgggtaaaccgtaaaccccggttccggttaccgggttaccccggtaccccgggtacggggtaccccgtaaaccggggtaccccgttacggtaccccctacccgggttccctcccggtaacccg

SEQ ID NO: 173077 - DNA, 742 bp, Homo sapiens
  misc_feature: GYAE6OF01CUHW0.7.76.G10.1.454.CMB.1.raw
  modified_base (727)..(727): a, c, t, g, unknown or other
  misc_feature (727)..(727): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagtcttgctgtagaggaagaaggagccggcgtggtccagccgtgggacgtccctgagacctctcctgtcgcacgtcctgtggtacttccaccttctaccttcctatcgtactttccgacgttcgggtcccgaccaacggtacctaccgaaggtaaccggaagggggtccgtaggggaggttgggggtacgaccgtaacgttacaagttaactactaagtttaggagtagggtaactaaccgttaaaatttaaaaacgttttgtacggaccggtaaccgttaccggtaaggtaaaccggttcgtaacttacccaacctactacctaacgaagtaacgtaacctaacgttacccgaaggtaacctaacgttactttcgtttacgaagtaaaacctaaagttaccgaaacgtaccgtaccgtaaggtaagttaacgttaggtaacggtacggttaacggttaacttaacgttaaccgttacgtcggtacccgtacccgttccgaacccctagtaccgtaacgaaccgtaaccggtcgttaccgggtccgtacccggacgggaccgaaccggtacccgtggtacccnccgtcctccgtaccg

SEQ ID NO: 173078 - DNA, 708 bp, Homo sapiens
  misc_feature: GYAE6OF01AYWTZ.7.76.G10.1.454.CMB.1.raw
  modified_base (263)..(263): a, c, t, g, unknown or other
  misc_feature (263)..(263): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggtattcaccttcacttcctatgtactttccacgtcggggtcccnccaacgacctaccgacgtaacgaaggggtctagggaggtcgggtggctagtcattactctaattgaactggacgtacctaaattaaatttcgcggacggtaccgttccggtaggaaaccggttcgtaacttccaacctatcctacgagataactacttacgaacggaactacctacgttcgtttacacgtaactaaagtacgaaccacgtaccgtaggaacgtaagttacgggaacggtaacgttacgggtaattaacgttaacccgttacggttacggtcccgtaccccggttaccgaacccccgttagtaaccgtaccgggtaaacccgttaaacccggggtcgtttacccggggtaccccggtaacccccgggttacgggaccccggaaccgggttaacccccgttgggtaaccccctacccggttcctccccgtaccccgg

SEQ ID NO: 173079 - DNA, 683 bp, Homo sapiens
  misc_feature: GYAE6OF01AH33O.7.76.G10.1.454.CMB.1.raw
tcagcgtgtctctacacgaccggtgctcgatttagtcactcatacaggagaggcgtcttctgtgtgtagtggttgtgcagagcctcatgcatcacggagcatgagaagacgttccctgctgccacctgctcttcgtccacggtgagcttgcgtgtacgaggaaaggaagggagccgggcgtggtccacggccgtggggacggtccctggacgactctcctgttgcagcctgtcggtattccgaccttcacgtttccctatcgtactttccacgttcggtccgcctaggaccctccgagtaccggacggggtctcgggaggtcggggtggacctaggtcattacgtacaagtttcggagtggaacgtactaaacgtttaaaagtttcgtaggcccggttacgtacccggtagtaaacccgggtctagtacctaccctagtcctacgaggtacaacgtacgtacacgtaacacgtacttcgtttacacgtaactaaacgacgtaacacgtaccgtagaacgttataacggacggttaacgtacgggttaactacggtaacttcgtaagttcccggtaccgtacccgtacccgtcgtacgtccgtaacgtaaccgtccgttacggtccgtaccccggtggaccccgtacgggtaacccgtcggtacctcccgtccgtcgtacccgg

SEQ ID NO: 173080 - DNA, 745 bp, Homo sapiens
  misc_feature: GYAE6OF01A5FHZ.7.76.G10.1.454.CMB.1.raw
  modified_base (333)..(333): a, c, t, g, unknown or other
  misc_feature (333)..(333): n is a, c, g, or t
tcagcgtgtctctacacgaccggtgctcgatttagtcactcatacagggaggaggctcttctgtgtgtagtggttgtgcagagcctcatgcatcaccggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtactttccacgtgggtccgccacgactccagaccgaaggggctggagtgggtggcagtcatatcaagttgatggagccaattaaaattttngcggactccgtgaacggtcgtattccacctattcctaccagacgaacctaacttaccgaacgggaaaccacgtacttgtttacgtcgtaacgtaaatcgtaaacctacgtacccttaggaacgtaaacgtttagggaacgggttaaccgttacggggttaaacttaacgtttaaccgttaaccggtttacggttacccgggtacccccgggttacccggtaacccccccgttagggtaacccgttacgggtaaaacccggttaaaaaccccggggtacccggtttaccggggtttacccccggtaaccccccggggttaccggggggtaaccccggtaaacccgggggtaaccccccggtttaccgggtaccccgtaacccccggtttcccgttcccccgtttaacccccgg

SEQ ID NO: 173081 - DNA, 660 bp, Homo sapiens
  misc_feature: GYAE6OF01BTGPK.7.76.G10.1.454.CMB.1.raw
  modified_base (168)..(168): a, c, t, g, unknown or other
  misc_feature (168)..(168): n is a, c, g, or t
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgcttcttgtccacggtgagcttgctgtagaggaagaggngcggcgtggtccagccgtgggacgtcccngagcctctcctgtgcacgtcctcgtggactttccacctttcgaaccttcctatcgtactttccgacgtcggtcccnccagacctcgagacgaaggggctggaggtgggtcgcagtcatactactagttgagtggacgtaccttaaatttaaagttttgcggtacggtacgttcgtaggtaaccgtcgtacttccacctagtccacgagacgaactacgtaccgaaggaacctacgtacgtttcgttacctagaactaaacgtacgtaacagtaccgtaggacgtaacgttggtaacgtacgttacggttaattacgtaaccttcggttcgtcccggtacccgtacccgtaccctggtaacgtacggtaaacgttaacccgggtccgttacggtaccccggtcccggtcggggacccgtaacggggtaccccgttcggacccgtacccgttccgtcccgtaccg

SEQ ID NO: 173082 - DNA, 664 bp, Homo sapiens
  misc_feature: GYAE6OF01COWXV.7.76.G10.1.454.CMB.1.raw
  modified_base (213)..(213): a, c, t, g, unknown or other
  misc_feature (213)..(213): n is a, c, g, or t
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaggcgccggcgtggtccagccgtgggacgtccctgacgtcctctcctgtncagcctgtggtacttccaccttcaccttcctatcgtactttccacgttcgggtcccaccacgacctccgagacggaaggggctgggaggttgggtcgcgtagtacagttactactaagttcgagtacggagtaaccttaaatttaaattttagcggaccgtacgtccgtagtaacggttcattccactatcctaccganacgactaactacgaacggaacctactacgttcgtttacncgaactaacgtacgaaaccncgtaccgagtaacgtagtacgacggtacttggtaactaacgtactacgttaggtcccgtaccgtacccgtacccgtacgtacctacggtaaccgttaaacccgggtccgtacgggttaccccggaccccggtgggtaaccccgtacccgggtaccgttacccggtaccctacccggtcccgtcccgtacccgg

SEQ ID NO: 173083 - DNA, 641 bp, Homo sapiens
  misc_feature: GYAE6OF01E1S9D.7.76.G10.1.454.CMB.1.raw
  modified_base (173)..(173): a, c, t, g, unknown or other
  misc_feature (173)..(173): n is a, c, g, or t
  modified_base (256)..(256): a, c, t, g, unknown or other
  misc_feature (256)..(256): n is a, c, g, or t
  modified_base (326)..(326): a, c, t, g, unknown or other
  misc_feature (326)..(326): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagcctgggaggtccctgagactctcctgtgcagcctctggattcaccttcacttcctatgatttccactgggtccnccagactccagacaagggctggagtggtgcagtcatatctaattgatggagacctaaattaaaattttancggacgtacttccggtagaacggttcgattcaacctatcctacagacgaactaacttccaaggtaaccactacgttagtttcctagacctaaatcgaaacgacgtacctagaagtaattaggacgggtaacgttacggggttaattaacgttaacttaacgttcggttacgaccccggttaccgtaaccccccgttgaaccgttacgaaccgttaaaacccgggtccgtttacggggtacccgtaaccccccggtcgggggaccccgaaccggggtaacccctacgggtacccacccggttccctcccgtacccg

SEQ ID NO: 173084 - DNA, 773 bp, Homo sapiens
  misc_feature: GYAE6OF01ETO1P.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggtgtggtccagccgtgggacgtccctgacgctctcctgtcgcacgtccttgtggtacttccacctttcacctttcctatcgtactttccgacgttcgggtcccaccagacctccgaaggacgaaggggtctgggaggtcgggtcgacgagtacatactactaagttgtagtggaacgtactaaatttaaaacgttttgacggtaccggtacgttaccggtagggtaacccggttacgtacttacccgaaccttactaccgtaccgaagtacgtaacctaacgttacccgaaaggaacctacctacgtttcgttacgacgtaacaaagttacgaaacgtcgtaccgtaaggtaactaagtttacgggaagtaccggttcggttaaacttaccgtacgttaaccgttcgggttacccgtccccggttaccgtacccccgtaggtaacccgtaacgtaaacccggtttaaacccggggtccgtttacccggggttaccccccgggtaaaccccggggtcccggggggtaaaccccgtacccgggggtaaaccccccgtttcgggtaacccccgtttacccggtaccccgttccccgtaaccccggg

SEQ ID NO: 173085 - DNA, 831 bp, Homo sapiens
  misc_feature: GYAE6OF01DHYH0.7.76.G10.1.454.CMB.1.raw
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgcctgccacctgctcttgtccacggtgagcttgctgtagaggaagaggngccggcgtggtccagccgtgggacggtcccngagactcctcctgtgcacgcctctggacttccaccttcaccttcctatgtactttcccgacgttccgggtcccgccacgtacctacccgaaggaccggaagggggccgttaggggtaggttcgggggtacgggaccgtaaggttaccctaagtttaataccgttaaagtttaggaagttcgggaacgtaacccttaaaagttttaaaaacttttttgtacggtaccgggttaacccgttcccggtacgggtaaaccgggttcttaaccgtttacccaacccgttacttcccgtaaccgacggtaacggtaacccttaacgtttaccccgaaacggtaaaccctaccgttaaccgttttcgttttaccgtaacggtaaacctaaaaggttacgaaaccgtaccggtaccgtagggtaacgttaaagtttacgggaacggttaacggttacgggtaatttaacgttaccgttacgtcggttacccgtaccccgtcccgtacccctaggtacccgttacgtaaccggtaaacccggtcgtttacccgggtaccccggtacccccgggtacggggtaccccgtaaccgggttacccggttaccggtacccgtaacccggttccctcccgtaacccg

SEQ ID NO: 173086 - DNA, 793 bp, Homo sapiens
  misc_feature: GYAE6OF01C91UL.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgccacctgctctgttccacggtgagcttgctgtagaggaagaaggacgccggcgtggtccagccgtggggacggtccctgacgacctctcctgtcgcacgtccctctggtacttccacctttctaccttcctattcgtactttccgacgttcgggtcccgaccagacctccaacggaacggaaggggtcgtaggggaggtggggtacggacgtacggtactagttactacgtaaagtttggaagtcgggtaaacgtacccttaaaattttaaaacgttttcgtacgggtaccggtaacccgttccggttaagggaaccggtttaccgtaactttacccgacctacgtacccgttacgaacggtaacgtaacctaaacgtttaccgaaacggtaaacctaccttacgtttcgttttcaacgtaacgtaaacgtaacgtaaccgaacgtaccgtaaggaagttaacgttacggaacggtaccgttagggtaattaaccttaacgttacgtcgttccgtaccccggtccgtaaccccgtaggtacccgtacggtaaaccgttaacccgggacgtttaccccggggttacccggaacccccggggtcggggtaaccccgtaaccggggtacccctttacggaccccgttaaccccggtccgtccccgtaacccgg

SEQ ID NO: 173087 - DNA, 816 bp, Homo sapiens
  misc_feature: GYAE6OF01CCOT6.7.76.G10.1.454.CMB.1.raw
  modified_base (99)..(99): a, c, t, g, unknown or other
  misc_feature (99)..(99): n is a, c, g, or t
tcagcgtgtctctacacgaccggtgctcgatttagtcactcatacagggagaggctcttctgtgtgtagtggttgtgcagagcctcatgcatcacggancatgagaagaccgttcccctgctgccacctgctctgtccacggtgagtcttgctgtagaggaagaggcgccggcgtgtccagccgtgggacgtccctgacgactctccgtgtcgacagtcctcgtggtacttccaccttctacctttctagtgttacttacccgacgtccggtcccgaccaacgtacctacccgaaggaaccggaacgggggtcgttaggggagggttcggggtcggacctaaggttccaaacgttagtacgtaaacgtttagggaacggtagggtaacgtaacctaaaagtttaaaaagtttttcggaccggtaacgggttacccgttaccggtaacggggtaaaccggtttccgtaacttacccgaaccgtaccgttacccgtaaccgaacggtaaaccgtaaccgtaaaccgtttacccgaaaccgggtaaaacctaaccgttaaccgttttacggtttacctaacggaaactaaacgttacgaaacgtacgtccgtaaggtaacggtaaacgttggaacggttacgtacggttaattaacgtaccgtacgtcggtaccgtcccgtaccgtacccgtagtaccgtacggtaaaccgttaacccggtcggtttacccgggtacccccggtacccggggtaccggggtaccgtaaccgggtaccccgttacggtaacccgttccccgttcccgttaccgtaccccg

SEQ ID NO: 173088 - DNA, 752 bp, Homo sapiens
  misc_feature: GYAE6OF01A5JPN.7.76.G10.1.454.CMB.1.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (741)..(741): a, c, t, g, unknown or other
  misc_feature (741)..(741): n is a, c, g, or t
tcagcgtgtctctacacgaccggtgctcgatttagtcactcatacaggagaggctcttctgtgtgtagtggttgtgcagagcctcatgcatcacggagcatgagaagacgttcccctgctcgccactgctcttgtccacggtgagccgttgcgtgtaggaacggaagaaagggacggccggcggttggtcccagtcccggtgggacggtccgtagacgtactccgtcctggtcgcacgccgtacgtgattcctaccgttccaccttcttacgtntacgtttaccncgttcggtacccgtacctacgaccttaccgacgtaaccgacggggtcgtggacggttgggacggtacgagtcgattagctaagtcgagtacggataccgaatttaaacttagtagtaccggacgttaccgtaacggaaacggttccgtaaacgttccgtaaaccctacgttccgtaaacccgtacggtaacgtaaaccggttaacctttaacccgaaacgggttaaaccctaaccggttaacccgtttaacgttttaccgtaacgtaacccgttaaaacgtacgttaaaccgaaccgtaaccgtacggtaaggttaacgttaacggtaccgggtaacgttaaccgggttaacttacggttaacctaacggttacgtacgtacccgtccgtaacccgtcgtacgacgtacgtaaccgcgttacgaccggtcccgacggacgacgtaccgacgtaccnccttcgctccg

SEQ ID NO: 173089 - DNA, 719 bp, Homo sapiens
  misc_feature: GYAE6OF01BH63D.7.76.G10.1.454.CMB.1.raw
  modified_base (270)..(270): a, c, t, g, unknown or other
  misc_feature (270)..(270): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctagtagaggaacgaaggagccggcgtggtccagccgtgggacggtccctgacgaccttctcctgtgcacgcctctggacttccacctttcacttcctatctactttccacgtcggtccncagacctacgagacgagggtctaggaggtggtgctagtcaagtactactagttagagtaggactacctaaatttaaacttttagcggaccggtacgttaccggtaaggtaaccggttacgtattacccaacctacgttccgtaaccgaagtaaccgtaactaaaccgttaccgaaacggtaacctacttaaccgtttcgtttaacgaacgtaaaccgaaagttacgtaaccgtacgtaccgttagaacggtaacgttacggaacggttaccgttacgggttaacttacgtaccgttaacgtccggtaccgtaccccgttaccgaacccctaggtaaccgttacggtaaaccgttaaacccgggtacgttcccgggttacccggaccccgggttccgggaacccgaacccgggtaccctacggtcccgtaaccgttcccgacctaacccg

SEQ ID NO: 173090 - DNA, 564 bp, Homo sapiens
  misc_feature: GYAE6OF01A7DI4.7.76.G10.1.454.CMB.1.raw
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggaggtccctgagactctcctgtgcagcctcgtggattccaccttctaccttcctatgtactttccacgtcgggtccgccagacctccagacgaaggggctgggaggtgggtgcagtcatagtataattgatggagacctaattaaatttangacggtactccgtagaacggtcgattcgaccatctcaganactaatccaaggaaccactacttgtttcatacaaatcgaacncgtactagataagttgagtacgtcggtaatagtactacgtgtacgcccgtccgacccgtgactagtaacgtaaccggtcgttccggtacccgtcccgacggggacccacgggtacccctcggtacccacccgtctccgtaccg

SEQ ID NO: 173091 - DNA, 696 bp, Homo sapiens
  misc_feature: GYAE6OF01DB1X8.7.76.G10.1.454.CMB.1.raw
  modified_base (119)..(119): a, c, t, g, unknown or other
  misc_feature (119)..(119): n is a, c, g, or t
  modified_base (175)..(175): a, c, t, g, unknown or other
  misc_feature (175)..(175): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
tcagcgtgtctctacacgaccggtgctcgatttagtcactcatacgagggagaggctcttctgtgtgtagtggttgtgcagagcctcatgcatcacggagcatgagaacgccgttcccngctgccactgctcttgtcccaggtgagtcttgctagagaaggaagaaggcgccggngtacggtccagtccgtgggacgtccctgacgtacctcgtccgtgtacgcacgtcctgtgtacttccaccttnaccttctatcgtacttccgacgtcggtcccacagtacctaccgaggacggagggtcagggagttgggagctagtctanctacgatgacgaggactaccttaaatttaacgtttgacggaccgttaccgtacggtacggtaaacggtctacttaccaactacgtacccaacgaagtaacgtacctaaccgttaccgaaagtaaccctacgttacgttacgtttaccaagtaaacgtaactacgaaccgtagacccgtaaggaacgttagtaacgggtacggtaaccggtttaacggtaattacccgttacgttacgtaccgttaccggtaccccgttaccgaccctaccgtagtaacccgtaacgtaacccggtcggtacccggtacccgtcccgggacgggaaccgtaccgggtaccctacggtaccctacccgttccgtacgtacccg

SEQ ID NO: 173092 - DNA, 738 bp, Homo sapiens
  misc_feature: GYAE6OF01AO907.7.76.G10.1.454.CMB.1.raw
  modified_base (275)..(275): a, c, t, g, unknown or other
  misc_feature (275)..(275): n is a, c, g, or t
  modified_base (721)..(721): a, c, t, g, unknown or other
  misc_feature (721)..(721): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctagtagaggaagaaggcgccggcgtggtccagccgtgggagtccctgagtacctctcctgtgcacgcctctggtatttccaccctttcacctttcctatcgtactttcccacgttcggggtccnccgaagaccctccgaaggacggaacgggggctagggaggtggggtggacctaggttcaattacgtacctaaagtttggacgttacgggacgtaaccgttaaaattttaaaagtttttacggcggtaccgggttaaccttcccgggtaacggaaacccggggttctaaacgtttcccaaccctacgtcccgttaccgaagtaaccgtaactaaccttacccgaacggtaaacctacgtactttaggtttaccacggtaacaacgttacgaacctacggacctagaacgttagttacggaacggtaacgttaccgggtaattaccttacgtaccgttcggaccgtaccccgttaccgaccctgaccgtaacggtaaccgtaaccgggtaccgttcgggtaccccgcccgggttcgggaacccggtacgggtaacccctcgggtacccncccgtccgtcccgtccg

SEQ ID NO: 173093 - DNA, 609 bp, Homo sapiens
  misc_feature: GYAE6OF01EG84R.7.76.G10.1.454.CMB.1.raw
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
  modified_base (520)..(520): a, c, t, g, unknown or other
  misc_feature (520)..(520): n is a, c, g, or t
tcagcgtgtctctacacgaccggtgctcgatttagtcactcatacagggagaggctcttctgtgtgtagtggttgtgcagagcctcatgcatcacggagcatgagaagccgttcccctgctgccacctgctcttcgtccacggtgagcttgctgtagaggaagaggcgccggcgtggtccagccgtgggacgtccctgacgaccttctccgtgtcgcacgtcccttgtggtacttccctacctttcctactttcctatcgtactttccgacgtcgggtcccgccacgacctaccgagacggaggggcgtagggagggtgggtcggacgtagtctaatatactaagttgagtaggactactaaatttaaatttcgcggcgtacgtcgtaggacgtctactcacctatctaccaagactaactaacgtaccgaagactactactttgttcaactacaatacgaacngtctagatagtgagtacgtagtaanatacgtactcgtccgtccgcccgtacccgtnacgtaccgtaaacgtaccggtcgtacccggtcccgacccgggcgggacccgtaaccggtacccgtcgtacctcccgttccgtccacccg

SEQ ID NO: 173094 - DNA, 1080 bp, Homo sapiens
  misc_feature: GYAE6OF01DACRS.7.76.G10.1.454.CMB.1.raw
  modified_base (167)..(167): a, c, t, g, unknown or other
  misc_feature (167)..(167): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagccgtgggacggtccctgagacctctcctgtcgccacgcccttcgtggtacttcctaccctttcacctttccctattcgtaccttttcccaccggttcgggtccccgaccgaacggtacccttacccgaacggaaccggaacggggggttccgtagggggtaacgggttgggggttcggaccgtacggttacctaaacgtttacttaccgtaaaagttttggaacgtacggggtaacgtaacccgttaaaaagttttaaaaacgttttttacgtaccggggtacccggttaacccggtttaccccgggttaacggggtaaaacccggggtttacccgttaaaccgttttaaccccgaaaccccgtttaacgtttacccccgttaacccggaaagggtaaaacccgttaacccgttaaaccgtttacccccggaaaacggggtaaaccccgtaacccgtttaacccgtttttccggtttttaacccggttaggtaaacccgtaaaaacgtttaaccgggtaaaccctaccgggtaaccccgttaagggtaaaccggtttaaaggtttaaccggggtaaaccgggttaacccggggttttaaccgggtttaaactttaaccggttttaaccgttaaccggttccggttaccccgggttaccccccgttacccgggttaccccccccttaacgggtaaccgttaacccggggttaaaacccggttaaaacccccggggttcccgggttttaaccccggggtttaacccccccggggtaaccccccccggggtttaaccgggggggaaccccccggttaaaccccggggggttaaccccccgttaaccgggtttaccccccggtaacccccgggttttaccccgtccccgttaaacccccggg

SEQ ID NO: 173095 - DNA, 867 bp, Homo sapiens
  misc_feature: GYAE6OF01BAGKP.7.76.G10.1.454.CMB.1.raw
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (559)..(559): a, c, t, g, unknown or other
  misc_feature (559)..(559): n is a, c, g, or t
tcagcgtgtctctacacgaccggtgctcgatttagtcactcatacagggagaggctcttctgtgtgtagtggttgtgcagagcctcatgcatcgacgggagcagtgagaacgccgttcccctgctcgccacctgcctcgttgtccgacggtgacgtcttggcttaggaaggaagggaaggaacggcggccggtcggtcggaccgnggtccgttaggggaccgtcccgtaggacggtccttcgtcgtggtcgacgcgtcccgttntggttacttcctaacctttcgtacctttccgtatacgttaccttaccgtacggtcggtacccgaccacgtaccgtaccgaggaaccggtaggggtaccgtgggacgggttcgggtacggcgtaacgttcgaatttaccgaaggtttaagttggtaacgtacgggttaaactaaccttaaaaagttttaaaactttcggcggtaaccgtaacggtacggttaacggtaaccggtactaccttaaccgaaactccgtacgtacgaaacggtactaaccgtaacgtaacccggtaaanaacccttacgttcgtttaacgttacacggtaaaccttaaaagtaccggaaccgttcgtaacgttaaggaaacttaacgggtacgtaaccgggtttaaccgttaacggttaaattaaccgttaccgttgtccgggttaacccgacccgttaccccgtaacgggtactacggttaaaccgaaacccgggttacccggtccgggttacccgggaaccccgggttcccgggggaacgttaaccccgggggtaccccggttaacccgttaccggttaaccccgacccgggtttccccctaccggggtaaaccc

SEQ ID NO: 173096 - DNA, 893 bp, Homo sapiens
  misc_feature: GYAE6OF01BZDXO.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttccctgctgccacctgctcttgtccaggtgagcttgctgtagacggaagaaggcgccggcgtaggtccaggccgtggggacgtccctgacgtacctctccgtgtcgctacgtccttcgtaggtacttcctaacctttcctaaccttcctaattcggttaacttttccccgaacggttccggggttacccaccgacggtaaccttacccgaaggtaaccgggtaaacggggggtcctagggggtaagggttcggggtacggtacctaaggtactaacgttactacgtaaagttggtaacgtacgggaacgttaaccttaaaagttttaaaaacgtttttcggacgggtaccggttaaaccgttacccgggtaacggtaacccggggttcttaacgtttaccccgaacccgtaagttccccgtaacccgaaggtaaccgtaaccttaacgtaacccgtaacgggaaacctacgttacgttcgttaccgtaacgaaccgtaaagtacggtaactacggtacctaaggtaacgtaaggttacggtaacgggtaccgttaacgggtaattaaccgttaccgtaacggtttcggtaccccgtaacccgggttcccgtaacccccggttaggtaaccttaaaccgggtaaacccgttaaaccccggggtcgggtttacccggtacccccggggtaaccccggggttacgggtaacccccggtaacgggggttaacccccgttacgggttaacccgttacccccggttacgttccccggtaaaccccgg

SEQ ID NO: 173097 - DNA, 833 bp, Homo sapiens
  misc_feature: GYAE6OF01AP9UK.7.76.G10.1.454.CMB.1.raw
  modified_base (175)..(175): a, c, t, g, unknown or other
  misc_feature (175)..(175): n is a, c, g, or t
  modified_base (503)..(503): a, c, t, g, unknown or other
  misc_feature (503)..(503): n is a, c, g, or t
  modified_base (654)..(654): a, c, t, g, unknown or other
  misc_feature (654)..(654): n is a, c, g, or t
tcagcgtgtctctacacgaccggtgctcgatttagtcactcatacaggagaggctcttctgtgtgtagtggttgtgcagagcctcatgcatcacggagcatgagaagacgttcccctgctgccacctgctcttgtccacggtgagcttgctgtagagaagagagccggcgtgtcngcgtgggacgtccgtgagactctcgtgtgccacgtcctcgtggtacttacctaccgttacctaccgttttaccgttactggttaccttttaccgtaccggtcgggtttacccccgacgtaccgtaacccttcccgaacgggaaccgggtaacgggggcccttagggggtacggggttttaacggggccgggtacggtacggtacctaacggttttaactacgttaagttttacgggaaggtaggtaaccgtaaccgtttaaagtttaaaaacgtttttagcggtaacccggttcccgttaaacgggttaccgggtaaacccgggtttntaaacccggtttaccctaaaccccgtaagttacccccgttaacggacgggtaaacctaaccggttaaaccgttaaccgaaaccgggtaacctaacccgtaaccggttttacgtttacgtaaccgtaaacgttaaactacgtaaaccgtacncggtaacgagtttaacgtaggaaccgttacgtagttaactacgttactacgttacggtctaccggtaccctccgtcgaactcggtaaaccttaacgggcgttacccggtttacggccccgtacgggtacccgtaaacggccccttacggtaccctaccgggtaccttcccggtaacccg

SEQ ID NO: 173098 - DNA, 711 bp, Homo sapiens
  misc_feature: GYAE6OF01B9PB6.7.76.G10.1.454.CMB.1.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagcgtgtctctacacgaccggtgctcgatttagtcactcatacagggagaggctcttctgtgtgtagtggttgtgcagagcctcatgcatcgacggagcatgagaagaccgttcccctgctcgccacctgcttctcgtccgacggtgagcttgctgtagaggagaggcgcgcgtgccngcgtggcgtccngagctctcngtcncncgcctntgtacttccaccttctacttctatcgtacctttccgacgttcggtcccgacacggtacctaccgacggacggtaacgggggcgtacgggagggttgggtacggaccgttaacggtctaattaccgtaccgttaagtttcgggtaacgttacgggaacttaccgttaaaaagttttaaacgtttcgaacgggtacccggtacgtaccgggtaaggtaccgttacggtaaccttccgaacctcgtaccacggagtaacgtacctacctacgtaacgacctaacgtcgtttacgttcaacgacgtaaagtacccgtaaagcgtacgtaggtagtaacggtacgttaacgggtactaccggtttataacctacgttaaccggtccgttaccgtccccggtactacccgataaccgtacgtaaccggtaaccggtccgttacggtccccggtacggccgggtacccaacgggttacctccggtaactcccgttcaccgtcccg

SEQ ID NO: 173099 - DNA, 757 bp, Homo sapiens
  misc_feature: GYAE6OF01CRGDZ.7.76.G10.1.454.CMB.1.raw
  modified_base (272)..(272): a, c, t, g, unknown or other
  misc_feature (272)..(272): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggcgccggcgtggtccagccgtgggacggtccctgacgacctcctccgtgtgcacgtcctgtggtacttcctaccttctacttctatgtactttccacgtcggtccnccacgacctaccgaggacggaaggggtcgtagggacggttggggtggactagtcctaatacttacgtaagttcgaagtcgggaacgtaaccttaaaatttaaaacgtttttgacgggtaccggtaccgttaccggtaggtaaccggttactaacgttacccaaccgttacttccgtaccgaagtacgaactaaaccgttccgaaacggaaccctacgtacgtttacgttactagaacctaaagttacgaaaccgtacgtaccgtaggtaacgtaaggttacgggaaccggttaacggttacgggttaaatacgttaaaccgtcgttaccggtacccgtaccccggtacccgtaccccgtagacccgttaacggtaaacccggttaaaccggtccggtttaccgggtacccccggtcccggggtacgggaaccccggtaccgggtaccccgtcgggtaccctaccccgttccgtcccgtaaccccg

SEQ ID NO: 173100 - DNA, 861 bp, Homo sapiens
  misc_feature: GYAE6OF01ANMBC.7.76.G10.1.454.CMB.1.raw
  modified_base (210)..(210): a, c, t, g, unknown or other
  misc_feature (210)..(210): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacgtccctgagctctcctgtncagcctcgtggtacttccacctttcacctttcctattcgtacttttcccgacgttcggggtcccgcccaggtaccctaccgaacggaaccggtaaacggggggtccgttagggggtaggggttcgggggttcggaccgtaacggttcctaagttaacgtaaccgtaaagtttggaacgttagggaacgtaccctaaaattttaaaaacgtttttagtacgggtaccgggttaacccgttacccggttacgggtaaaccggttaccgtaactttacccaacccgttacgttaccctacccgaaacggtaaccgtaaaccgttaaacgtttaccccgaaacgggtaaaccctaacccgttaaccgtttacgttttaccgtaagtaacctaaaacgtacgaaaccgtaccgtacccgttaaggtaaaggttaagtttaggaacgggttaacgttaccgggttaaattaacgttaccgttaccgttcggttaccggtacccccgttacccgtaacccccgtaggtaccgtaacggtaaaccgtaaaacccgggttccggttacccgggttacccggacccccgggttaccggggaccccggtaaccggggttaccccgttacgggtacccctacccgttcccgtcccgtaccccg

SEQ ID NO: 173101 - DNA, 743 bp, Homo sapiens
  misc_feature: GYAE6OF01EWPQS.7.76.G10.1.454.CMB.1.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacggtccctgagacctctcctgtgcagcctntggattcaccttcacttcctatgtatttccacgtgggtccnccagacctccagacgaaggggctggaggtgggtggcaggtcatatctaagttgatggacacctaatttaaaattttagacggtcggtaacttcgttaggtcggtaaccgggtctagtttcccaactacttcctacgaagtacgtaactaacgtttcccgaaaggtaacctaacctacgtttagttttaccgtaacgtaactaaagtacgaaacgtacgacccgttaggaacggttaaagttcgggaaacgggtaaccgttacggggttaacttaacgttaacgttaccgttacggttcccggtaccccgggttacccgtaaccccccgttagtaaaccccgttaaggtaaacccggtaaaccccgggttaccggttaccggggttacccccgaacccccggggttacccgggggaaccccgttaaaccgggggtaacccccgttaccggggtaaccccttaccccggttcccttacccccggg

SEQ ID NO: 173102 - DNA, 697 bp, Homo sapiens
  misc_feature: GYAE6OF01CUPPH.7.76.G10.1.454.CMB.1.raw
  modified_base (121)..(121): a, c, t, g, unknown or other
  misc_feature (121)..(121): n is a, c, g, or t
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (266)..(266): a, c, t, g, unknown or other
  misc_feature (266)..(266): n is a, c, g, or t
tcagcgtgtctctacacgaccggtgctcgatttagtcactcatacagggagaggctcttctgtgtgtagtggttgtgcagagcctcaatgcatcacggagcatgagaacgaccgttccccngcctgccacctgctcttgtccaggtgagtcttgctgtagaggaagaaggngccggngtgtccagcctgggagtccctgacgacttctcctgtgcacggcctcgtagacttccaccttcacttcctatgtacttccagtcggtccncacgactcctaagacgaacgggtctggagtggtcgcagtcagtactctaagtcgagtcggacgacctaaagttaaaagtttcgcggtaccggtacgtcgtaaggaaccgttacacttaccacgtactacctacgaagaaccgtactaaacttacccgaaacggtaactaacgtacgttagtttaccgacgaaacgtaaatacggaaacgtaccgtaccgtagaagttaacgtagggtaacggtaccggttacggtaaattacctaaaccgttcgttcgtacccgtaccccgtacccgtaaccccgtgtaaccgtaccggtaaaccgtaaacccggtcgttacccgggttaccccggaaccccggttcgggaaacccggttaccggtaaccccgttcggtaccccgtaaccgttccgtacccgtaaccccgg

SEQ ID NO: 173103 - DNA, 668 bp, Homo sapiens
  misc_feature: GYAE6OF01ARNGF.7.76.G10.1.454.CMB.1.raw
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacgtccctgagactctcctgtcgcagcctcgtggacttcaccttcacttcctatgacttccacgtgggtccncagacctacagacgaagggctggagtgggngctagtctatcgtactaagttgagtggacgtacctaatttaaatttgcgcggtactccggtagaaccggtctaacttcccaacctattcccgtacaaggtaacgtaacctaacgttaccgaaggtaaccaccgttacttacggtttctaggtactaaacgttacgaaccgaacggtaccctaaggaacgtaagttacgggtacggtaacgttacgggttaacttacgtaacgttacgttacgtacggtccccgtaccgaccccgtagtaccgtacgaaccgtaacccggtcgttaccgggtacccggacccggtcgggggacccggtaaccgggtaccccgttacggtacccgtacccgttcccgtacccgtacccg

SEQ ID NO: 173104 - DNA, 688 bp, Homo sapiens
  misc_feature: GYAE6OF01A6FM7.7.76.G10.1.454.CMB.1.raw
  modified_base (144)..(144): a, c, t, g, unknown or other
  misc_feature (144)..(144): n is a, c, g, or t
  modified_base (166)..(166): a, c, t, g, unknown or other
  misc_feature (166)..(166): n is a, c, g, or t
  modified_base (172)..(172): a, c, t, g, unknown or other
  misc_feature (172)..(172): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtnagcttgctgtagaggaagaggngccggngtgtcagcgtgggacgtcctgagctctcctgtgcagtcctcgtggtacttcctaccgttctacttcctattcgtactttccacgtcggtcccgccacgctccaggacgaggggtctggaggtgggtgctagtcatgtactaagttgagtggacgtaccttaaagtttaaacttttgcggaccgggtaccttaccggtacgggtaaaccgttcgtaactttcccaaccctattcctaaccgaagtaacaaccgttacgtacccgtaaggaacctaacgttaaccgtttgttttaccgagtaactaaagtaccgaacttacgaccgttagtaacgtagttacggaacgggttcgttaaggttaacttaacgtaccttacggccgttacgtccccgtaccgtcccctagttacccgtacgtaacgttaacccggacgttacccggtcccggtaccccgggacggggtaccccgtacggtaaccccggttcggtacccctcccgtccttcccggtacccg

SEQ ID NO: 173105 - DNA, 751 bp, Homo sapiens
  misc_feature: GYAE6OF01AUGEL.7.76.G10.1.454.CMB.1.raw
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccacggtgagcttgctgagaggaagaggngccggcgttggccagccgtgggacgtccctganctctctgtcgcacgcctgngtacttccaccttcacctttctatcgtactttccgacgtccgggtaccaccacgacctaccaaggacgaaggggtctaggggaggtcgggtgactagtctaatacgtactaagtcggaagtgggactacctaaaattttaaaagtttcgtacgggacccggtacgttacccggtacggtaaccgggtacctaacttacccaaccgtactacccgtacgaaggtaacgtaactaaccgttaccgaaaggaaccctaaccttacgttacggtttacaacggtaaaccttaaaaggtacgaaaccgacgtacccgtaaggtaagtaacggttaaggaacggtaacgttaacgggttaattaaacccgtacgttaccggtcggtacccgtacccccgtaacgtacccccgtagaaccgttaaccggaaaccgttaaacccgggtccgttacccggttacccggaccccggtaccgggtaacccggtaacccgggtacccgtaaggtacccccgtaacgttccccgtacgtacccgg

SEQ ID NO: 173106 - DNA, 934 bp, Homo sapiens
  misc_feature: GYAE6OF01B9D7N.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccacggtgagtcttgctgtagaggaaggaggacgccggcgtgtccagcgtgggacgtccctgacgtactctccgtgtcgcgtacgtccttcgtggtacttacctaccctttacctacctttcctagtacgttactttacccgacggttccgggtacccaccgacgtacctaccgaacggacggtaacggggtcgtaggggtaggtcggggtacgaccgtagttacgtaagttactaccgtaagtttaggaggtacggtaacgtaaccttaaaattttaaaacgttttagaccggtaccggtaacccgtttacggaacgggttaaccggttacgttaacgttacccaacccgtacttaccctaaccgtaacggtaactaaccgttaaccttaacccggaaacggtaaccccttaacgtttaccgttttcgtttaaccggtacgtaaaacgtaaaccggttaaccgaaaccgtaccggttaccgtaaggtaaacggttaacgggttacggaaaccgggttacgggttaacggtttaacttaaaccgtttaccgttaaaccggttccggttaaccccgggtcccccgttaaccccggtaccccgttaagggttaacccgttaaacccgggtaaaccgtttaaaacccccggggtcgtttttacccccgggggtaacccccccggtaacccgggggttaccgggggaaacccccggttaaacccgggggtttacccccggttacccgggtttaacccccgtcccccggtttaaccgtacccccccgggtttaaccccggg

SEQ ID NO: 173107 - DNA, 678 bp, Homo sapiens
  misc_feature: GYAE6OF01BJ2CT.7.76.G10.1.454.CMB.1.raw
  modified_base (479)..(479): a, c, t, g, unknown or other
  misc_feature (479)..(479): n is a, c, g, or t
tcagcgtgtctctacacgaccggtgctcgatttagtcactcatacagggagaggctcttctgtgtgtagtggttgtgcagagcctcatgcatcacggagcatgagaagtacgttcccctgctcgccacctgcttcttcgtccgacggtgagtcttgctgtagaaggaagaggacgccggcgtcgtccacgccgtgggacgtccgtagacgtactctcctgtcgcacgtcctcgtggtacttcctaccttctacttctatctactttccacgtcggtccgaccacgacctcgaacggacgacgggtcgtagggcggtgggtcgacgtagtactaatatactagtgagtaggactaacttaattaaagtttcgtacggtaccgtacgttacgtacgtaacggtacgtacttacaacctacttacctacgaagaacgtaaccttaacgtacccgaacgttaaccacgtttacgttacgttanaacgaacgtaaagtcgaactaccgtcgtagtaacggttagtacgtacgggtacttacggaattaacgacgtttacgtcggtaccgcccgtacctaccgtagtactacggaaacgttaccggcgttaccgggtaccggaccggtacggtaccgaaccggttcccggttaccgtaccctacccgtccgtcgtaaaccccgg

SEQ ID NO: 173108 - DNA, 809 bp, Homo sapiens
  misc_feature: GYAE6OF01A26HJ.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttccctgctgccacctgcctcttcgtccgacggttgacgtcttgctaggtaggaaggaaggaaggcggccggcgttggacccaggccgtggggacgttcccaggacgaccttcctccgtggtcgccacgtcctacgtggtaccttccaccctttcacctttactagttcgtaccgttttaccacggttcgggtaccccaccgtacgaccctacgaacggaacggaacgggggtctagggtacgggtgggtacggcctaaggtcctaatacgttaccgtaagttcggaacgtcggaaccgtaacttaaagttttaaaacgtttcgcgggtaccggtaccgttacggaacgggttaccggtacgtacttacccgaacctgttacccgaacgtagggtaacctaaccgtacgttaaccgggaacgtaaaccggtactttaaccggtttcgtttaaaccggtacgaaaccgttaaaccgtaacggaaaccgttacggtaacccgtagggtaacgtttaaaggttaccgggaaggttaaccgttacggtaacggttacttacgttaccggttcgggccgttacccggaccgtacccgttagacgttaaccgtaaccgttaaccggtcgttacccggtacccgggaccggtcgggaaccggtaccggtaccgtcggtaccccttcgtcccgttccgtaacccg

SEQ ID NO: 173109 - DNA, 861 bp, Homo sapiens
  misc_feature: GYAE6OF01EVDS9.7.76.G10.1.454.CMB.1.raw
  modified_base (145)..(145): a, c, t, g, unknown or other
  misc_feature (145)..(145): n is a, c, g, or t
tcagcgtgtctctacacgaccggtgctcgatttagtcactcatacagggagaggctcttctgtgtgtagtggttgtgcagagcctcatgcatcacggagcatgagagaccgttcccctgctgccacctgcttcttgtcccaggtnagtcttgctgtagaggaagaaggcgccggtgtgtccagtccgtgggacgtccctgacgaccttcctcctgtacgccacgtcccttgtacggtactttcctacctttccgttactttccttatcgttacttttcccgacggttcgggtcccgacctacgtaccgtaccgaacggaaccggaaacgggggtccgtagggggtagggttgggggtacggtaccgtacgttaccgtaattacgttacgtaaagtttggtaacggtacggaccgttaaccttaaaagttttaaaactttttacggaccgggtaccggtacccgttaccggtaacggtaaccggttaccgttaaccttcctaacccgtacttacccgtaaccgaaaggtaacctaaccttaacgttacccgaaacgtaacccgtacctttaacgtttacgtttaccgaataacgtaaacgacggtaaacctaccggtacccgttaaaggaacgtttaacgggttaacggtaccgggttaacggtttaacgggttaacttaacgtaccgttacgttcgggttaccccgaccccggttacccgtacccgtaggttaacccgtaacgtaaacccggttaaccgggtcgtttaccccggggtaacccgtcccccggggtacgggtaacccggacccgggttacccgttaccgggtacccttaccccggttccgtcccgtaaccccg

SEQ ID NO: 173110 - DNA, 853 bp, Homo sapiens
  misc_feature: GYAE6OF01CBRFU.7.76.G10.1.454.CMB.1.raw
  modified_base (268)..(268): a, c, t, g, unknown or other
  misc_feature (268)..(268): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccagcctgggacgtccctgatactctcctgtgcacgcctcgtggtacttccaccctttcaccttcctatgtactttccacgtcgggtcccnccagacctccagacgaggggctgggaggtgggtgcagtcatatactaagttgagtggacgtacctaaatttaaaattttagtacggtaccggtaccgttaccggtacggtaaaccgggttcgtaactttccaaccctacttaccgtaccgaaggtacgtaactaacgtttacccgaaacgggtaaacctaccgttaccgtttacggttttaccgtacggtaaaccttaaaaggttaccggaaaaccgttaacgggtaccccgttaagggtaaacgggtttaaacggttacggggtaaacggggtaaccggttttaccggggtttaaaactttaaccggtttaaaccgtttaccggtttaccgggtttacccggtcccccggtttaacccggtaaccccccgttaggtaacccgttaaacgggttaaaaccccggttaaaaccccggggttaccggttttacccggggttacccccgggtaacccccgggggtttacccggggggaacccccggttaaacccgggggtaacccccggttcggggtacccccggttaccccggttccccgttaccccgtaaccccgg

SEQ ID NO: 173111 - DNA, 740 bp, Homo sapiens
  misc_feature: GYAE6OF01ENYM1.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagccgttcccctgctgcccacctgctcttcgccacggtgacgtcttggcttggaaggaggaaaggaacgggacggcccggtcggttcggtaccgacggtcccggtaggggtaccgggttcccctaggaccgtacttcctcgttggcgaccgcgtcccttgtacggtacctttcctaacctttctaacgttcctatcgtacttccgtcgtcgggtccacctagacctaccgtaggaccgtaagggggcgtagggacggttgggcgacgaagtccataactacttaagttgagtacggaactaaccgtaaagtttaaacgttttggcgtaaccggtccggttacggaacggtaaccgtacgtactacgaacctacgtcctaacgacgactaacgtaacacggaacgtacgtacgtacttagtacacgtataacgtacgaacgacgtacgtagaacgtagtagaacgggtacgtacggtttaataacgttctaaccggtgttacccgccgtaaccgccccgtaaggtacctaccggtaaaccgtaaccgtaccggttacggtacccgggtacccgggaggttacccccggaacgggtacccgtacccgggtacctaccccggtcctcggtacccccg

SEQ ID NO: 173112 - DNA, 948 bp, Homo sapiens
  misc_feature: GYAE6OF01CXSGO.7.76.G10.1.454.CMB.1.raw
  modified_base (119)..(119): a, c, t, g, unknown or other
  misc_feature (119)..(119): n is a, c, g, or t
tcagcgtgtctctacacgaccggtgctcgatttagtcactcatacagggagaggctcttctgtgtgtagtggttgtgcagagcctcatgcatcacggagcatgagaagaccgttccccngctgcccacctgccttcttcgtcccacggtgacgtcttgctagtaaggaggaaaggaagggcgcccgggcgttcggtccaggccgtggggacggtccctaggacgtaccttcctccgtgtcgccacgtcctcgtggtacttcctaccttctaccttctatcgtactttccgacgttcgggtccaccgtacgacctaccgacggaacggtacgggggtcgtaggggtacggttggggtcggaccgtaggtacctaatttaactacgttaaagttaggacgtacgggaaccgtaaccttaaaaagtttaaaacgttttcgaccgggtacccggttaacccggttacccgggtaacgggtaaaccggttaccgtaactttaccccgaaccgtttaaccgttcccgtaaccgtaaacggaaccgttaaaccgttaaccgttacccgaaacggtaaaccttacccgttaacgttttcggtttaaccgtaacgtaaacccgtaaagtaccgggaaaccgtaacccggttaccggtaaagggttaaacggttaaacgttacgggggtaaacccggtttaaccgggtttaaacgggttaaaccttacggtttaaacccgttaccggttccgggtaacccccggttacccccggttaccccggtaaccccccgttaggtaaaccggtaaaccgggtaaacccgggttaaacccgggttcccggttaacccgggggttacccggtaccccccggggggtacggggtaaccccggtaaaccccggggtacccggtttaccggtaacccccgttaccggtccccttacccgggtaaccccg

SEQ ID NO: 173113 - DNA, 823 bp, Homo sapiens
  misc_feature: GYAE6OF01CGBH4.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttcgtccgacggtgagtcttgctaggtagaggaagaggacggccggcgtggtccaggcccgtggggacgtccctagacgacttcctccgtggtcgcacgtccctcgtaggtacttccacctttctaccgtttcctagtcgttactttcccgacgttccggggtccacccgaaggtaccctccgaaggtaccggtaagggggtcctagggggtaggttcgggggtcgactacggttacctaagttactaccgttaaagttggtaaggttggaaccgtaccgtaaaagttttaaaacgttttcggaccggaccggttaaccgttaccggtaggtaaccggttcggtacttacccgtacctacgttaccgtaccgtaagaacgtaacgtaacccttacggtaaacccggaacctaccgtaactttcggtttaacctacggaacctaaaggtaccgaaacgtacgtcccggtaagaaggttaacgtaggtacggtaaccggtttacgtaacgtaagttacccgttgtaccgggttctaccccggtacccgtaccccgtacgaacgtacggtaaacccggttaaccggtcccggtttaaccggttaccccgggtaccccgggtacggggtacccgtaacccccgggtacggtttacccggtacccggtaccccgtcccgtttaccccgaccccgg

SEQ ID NO: 173114 - DNA, 869 bp, Homo sapiens
  misc_feature: GYAE6OF01A4W47.7.76.G10.1.454.CMB.1.raw
tcagcgtgtctctacacgaccggtgctcgatttagtcactcatacagggagaggctcttctgtgtgtagtggttgtgcagagccctcatgcatcgacggagcatgagaagaccgttcccctgctagccacctgcttccttgtaccgacggtgacgtcttgctagtaaggaagggaaagaagggacggcccggcggttcggtaccgacggtccggttcggggacgtccccgtagacgtccttcgttaccgtggtcgacgtacgccttcgtaggtacctttaccctacctttcctactttaccgattacggttaaccttttacccgaacggttcccggggtacccacctaacggtaccctaccggaaggacccgggaaggggtcggtaggggtacgggttggggaccgacctacggtactaacttataaccgtaagttggaacggtaggaacctaaccgttaaaattttaaacggttttacggaccgggtaccccgttaacggttacccggtaagggtacccggtacttaaccttacccgacctaacgttccaaccgaaaggacgttaaacctaacgttaacccgaacgtaaccgtacgttacgttacgttacgtacgtaaactaaacgtaccgaaccgtacgtacgttaaggaagttaacggtaggaaccgggttaacgttaacgggtaacttacgttaaccgtcgtacggtacccgaccccggtttacccacccggttacgtaccgtacggtaaacgtaacccggttccgttacccgggttaccgggaccccggttaccggggacccggttaccccgggtacccggttaccccgggtaccgtaccccggtccgttaaccccgtacccgg

SEQ ID NO: 173115 - DNA, 553 bp, Homo sapiens
  misc_feature: GYAE6OF01A2KJ5.7.76.G10.1.454.CMB.1.raw
  modified_base (172)..(172): a, c, t, g, unknown or other
  misc_feature (172)..(172): n is a, c, g, or t
  modified_base (322)..(322): a, c, t, g, unknown or other
  misc_feature (322)..(322): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggngtggtccagcctgggagtccctgagactctcctgtgcagcctctggattcaccttcacttctatgtatttccactggtccgccagactccagacgaaggggtctgggagtcgggtgcagtcatatcaattgatgagctaataaaatttangacgtactcgtagaacggtcattcaccatctacagagtacaattccgaagaacactacttgtttactagacaaatacgaactagaccgtagaagtaattggaaggtactacggtatagtaactactgtcgcccgtacgacccctgactcggtaactaaccgggtctggttacccggacccgtgggaccgtaacgggtaccccttagggtcctaacccgtcttcccgtaccg

SEQ ID NO: 173116 - DNA, 895 bp, Homo sapiens
  misc_feature: GYAE6OF01D21CX.7.76.G10.1.454.CMB.1.raw
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagtcttgctgtagaaggaagaaggacgccggcgtggtccagccgtgggacgtccctgacgaccttctccgtgtcgcacgtcctcgtgacttccacctttcnctttacctatgtactttccacgtcggtccnccagactccgaagaacggagggtcgtgggaggtgggtcggcgtagtacattactactaagttgagtggaacgtacctaaatttaaaagttttgacggtaccggtacgttccggtaacggtaaccgggtactacgttaccaaccgtacttcctaccgaaggaacgtaacctaaacgttacccgaacggtaaacctaccgttaaccgttttacgtttaccgtaacgtaaccgtaaaacgttacgtaaaccgtaccggttacccgttaaggtaaacggtttaaacggtttaacggggtaacgggttaacccggtttaacggggtttaaacttaaccgttttaaaccgttaccggttaccgggttacccggttacccccggttaccccggtaaccccccgtttaaaggtaacccgttaaaccgggttaaaacccggttaaaacccccggggttaacccggttttaccccggggttaaccccccggggttaaacccccccggggggttacccggggggtaaccccccgggttaaaaccccgggggttaacccccggtttacccggggttacccccgtttaaaccccccgggtttccccctttaacccccccgggtaacccccgg

SEQ ID NO: 173117 - DNA, 783 bp, Homo sapiens
  misc_feature: GYAE6OF01ALSQ1.7.76.G10.1.454.CMB.1.raw
  modified_base (177)..(177): a, c, t, g, unknown or other
  misc_feature (177)..(177): n is a, c, g, or t
  modified_base (233)..(233): a, c, t, g, unknown or other
  misc_feature (233)..(233): n is a, c, g, or t
tcagcgtgtctctacacgaccggtgctcgatttagtcactcatacagggagaggctcttctgtgtgtagtggttgtgcagagcctcatgcatcacggagcatgagaagacgttccctggctgccacctgctcttcgtccgtacggtgagtctgctggtagaggaagaggacgccggnggtcggtcgacgtccggtagggacgtccgtgacggtactccgttccgtggtgaccncgtcctacgtaggttctcctaacccgtttctactttccgtattcgtaccttcctacgttccggggtcccaccacgtacgtaccgacggaaccggtacggggtcggtacgggtaggttcggggtcgacgtaaggtcctaaagttacgtactattaggaacgtggaactacgttaaaacttttaaggtttacgacggtccggtacgtccgttaggaaccgttcgttacactaccgtactcgtacgaacggtaagtacctacgttaccaacgtaaccgtacgtacgtttaacgtacgttctaacgtaaactacggtaaactacggtacgtacgtaacggtaagttaacgggaacgtttaacggtaccggtttaagtaccgtttaaccgttacgtttacccggcgttaacccggccgttaacccgtacggtaacgtacccggtaaacgttaaccggtaccggtttacccggacccgggtacccgacccgggtaaccggttaccggttaaccccgggtagttaaacccccggtcctccccgttaccggtaccccg

SEQ ID NO: 173118 - DNA, 975 bp, Homo sapiens
  misc_feature: GYAE6OF01BNIJR.7.76.G10.1.454.CMB.1.raw
  modified_base (173)..(173): a, c, t, g, unknown or other
  misc_feature (173)..(173): n is a, c, g, or t
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaggcgccggngtggtccagccgtgggacgtccctgacnctcctctgtgcacgtcctcgtggtacttccaccttcacctttcctattgtactttcccncgtccgggtccnccagcctaccgaagtaccggaggggtcggtgggggtcgggtcggacacggtataagttactacgtaagttgtatacgggactaaccgttaaaagttttaaaaacttttcggtacggtaccggtaacccgtttacccgggttaacgggtaaccgggtttaaccggttaaccttacccgtaaaccctacgtttaccctaacccggtaaaacggtaaccgtaaaccccgttaaaccgttaacccggtaaaccgggaaaaaccctaccgttttaaccgttttcccgttttaaccggtaaccgtaaaccgtaaaaccggtttaacgaaacccggtaaacgggttccccgtttaaaagggtaaccggtttaaacggttaacggggtaacgggtttaaaccccgggtttacgggtttaactttaaaccgttttaacccggttaccggtttacccgggtacccgttaacccccgggttcccccggttaacccccttaggggtaaccccgttaaacggaaaccccgggtttaaaaccccgggttacggttttcccccggggtaaccccccgggttacccccggggggttaaacccggggtaccccccgggggttaaaaccccggggttaaccccccgggtttacccggggtttaacccccctaacccccgggtttccccttccccccggtaaccccgggttaaacccccggg

SEQ ID NO: 173119 - DNA, 770 bp, Homo sapiens
  misc_feature: GYAE6OF01BUC9C.7.76.G10.1.454.CMB.1.raw
  modified_base (120)..(120): a, c, t, g, unknown or other
  misc_feature (120)..(120): n is a, c, g, or t
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
tcagcgtgtctctacacgaccggtgctcgatttagtcactcatacagggagaggctcttctgtgtgtagtggttgtgcagagcctcatgcatcgacggagcatgagaagaccgttccccngctgccacctgctcttgtccacggtgancttgctgaggagaagaggngccggngtgtccngccgtgggacgtcccgngacgccttctccgtgcgccacgtccttcgtagtaccttcctaaccctttctacctttacctagttcgttaaccgtttcccaccggttccggggtcccccacgaacgtacccgtaccgaaggaaccggacgggggtccgtaggggtaggggtttggggccggaacgtggtactaattataccgtaagttggacggtacgggaacttaaccgtttaaaagtttaaacgttttcggaccggtacggttacccttaccgggtaaggtaacccggttagtacctttaccgaccctacttccgaacgaagtacacgtaactaccgaacgtacacgtacttgttacgacgtaacaaacgtgaaaccgtcgtaccgtaaggacttagtaacggaacgggtttacgaacgtttaagttaccgttaccgttaaggttccgtaccccggcccgttaccccgacccggttatacccggtaccgtaaacccggtaaccggtccgtttcccgggtacccggccccgggtccggaccggtaaacccgggttcccgaccggttacccgtacccgtcctcccgtaacccg

SEQ ID NO: 173120 - DNA, 508 bp, Homo sapiens
  misc_feature: GYAE6OF02IVCKF.7.76.G10.1.454.CMB.1.raw
  modified_base (323)..(323): a, c, t, g, unknown or other
  misc_feature (323)..(323): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtcccgccagactccagacaaggggctggagtgggtggcagtcatatcaattgatggagccataaaattttntgcggactccgtgaacggtcgattcaccatctccagagacaattccaggaacacactgttctgcaaatgaacagcctgagaatgaggactcgggtatatactactgtcgcccgtcgacccctgactagactaaccggctcggttcgacccgtgggccacgggaccctggtccacgtcctccctcg

SEQ ID NO: 173121 - DNA, 503 bp, Homo sapiens
  misc_feature: GYAE6OF02GZD8V.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgttctgcaaatgaacagcctagagaattgaggactcgggtatatactactgtgcccgtgacccctgactgataaccggactggtcgacccgtgggccacggaccctggtccaccgtctcctccg

SEQ ID NO: 173122 - DNA, 547 bp, Homo sapiens
  misc_feature: GYAE6OF02HDRWC.7.76.G10.1.454.CMB.1.raw
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattccaccttcacttcctatgtattccactggtccgccagactccagacgaaggggctggagtgggtggcagtcatatcaattgatggagacctaattaaaattttangcggtactcgtagaacggtcgtattcaaccatcctcagagacatcagaacacactgttctgacaatagaacacgacctagagtaatagaggtacgtacggtatatactacgtgtacgtcccgtcgaccccgtagacctacgacgtaaccggtacgtcggttaccggaccccgtcgggaccgacgggtacccgtcggtaccgtacccgtccgtcctaccg

SEQ ID NO: 173123 - DNA, 527 bp, Homo sapiens
  misc_feature: GYAE6OF02HDCR8.7.76.G10.1.454.CMB.1.raw
  modified_base (324)..(324): a, c, t, g, unknown or other
  misc_feature (324)..(324): n is a, c, g, or t
  modified_base (405)..(405): a, c, t, g, unknown or other
  misc_feature (405)..(405): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaaattttangcggactccgtgaacggtcgattcaccatctccagagacaattccaggaacacactgtttctgacaaatgaacagcctganaattgaggactcgggtatatactactgtcgcccgtcgaccccctgacctgaactaaccggactcggttaccgaccccgttcggggcccgacgggacccgtcggtccgacccgtcctcctccg

SEQ ID NO: 173124 - DNA, 519 bp, Homo sapiens
  misc_feature: GYAE6OF02JFNND.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctagagaattgaggactgggtatatactactgtgcccgtgacccctgacctgactaaccggactggttccgaccccgtgggacccacgggaaccctgggtaccacccggttctccctaccg

SEQ ID NO: 173125 - DNA, 522 bp, Homo sapiens
  misc_feature: GYAE6OF02HI26G.7.76.G10.1.454.CMB.1.raw
  modified_base (324)..(324): a, c, t, g, unknown or other
  misc_feature (324)..(324): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaaattttangcggactccgtgaacggtcgattcaccatctccagagacaattccaggaacacactgtttctgcaaatgaacagcctagagaattgaggactcgggtaatatactactgtcgcccgtcgacccctgactgataaaccggactacggttccgacccgtcgggaccgacgggaacccgtcggtccacccgtctcctaccg

SEQ ID NO: 173126 - DNA, 513 bp, Homo sapiens
  misc_feature: GYAE6OF02H6JRX.7.76.G10.1.454.CMB.1.raw
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaattttangcgactccgtgaacggtcattcaccatctccaganacaattccaggaacacactgtttctgacaaatgaacagctagagaattgaggactcgggtatatactatgtcgcccgtcgacccctgactgaacgtaaccggtctcggttccgaccccgtgggacccagggtaccctggtccaccgtctcctccg

SEQ ID NO: 173127 - DNA, 549 bp, Homo sapiens
  misc_feature: GYAE6OF02HKDEV.7.76.G10.1.454.CMB.1.raw
  modified_base (256)..(256): a, c, t, g, unknown or other
  misc_feature (256)..(256): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccnccagactccagacaaggggctggagtgggtggcagtcatatcaattgatggagccaattaaaatttatgcggactccgtagaacggtcgattcaacctatcctaccagacgactaacttccaaggaacacacttgtttctgtacaaatgaacagcctagagaattagaggtactcgggtatatactactgtcgccgtacgacccctgtacctagtaacgtaaccggtacgtcggttaccgacccgtacggggacccgacgggtacccgtcggtacctacccgtctccctaccg

SEQ ID NO: 173128 - DNA, 518 bp, Homo sapiens
  misc_feature: GYAE6OF02GNQX7.7.76.G10.1.454.CMB.1.raw
  modified_base (322)..(322): a, c, t, g, unknown or other
  misc_feature (322)..(322): n is a, c, g, or t
  modified_base (397)..(397): a, c, t, g, unknown or other
  misc_feature (397)..(397): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaatttangcgactccgtgaacggtcgattcacatctccagagacatcagaacacactgttctgacaaatgaacagcctaganaattgaggacgtcgggtatatactactgtacgcccgtcgacccctgactcgaacgtaaccggtactcggttccgtacccgtgggacccgacgggacccgtcggtccaccgtcctcctaccg

SEQ ID NO: 173129 - DNA, 510 bp, Homo sapiens
  misc_feature: GYAE6OF02GB5CL.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgacaaatgaacagcctagagaattgaggactcgggtatatactatgtgcccgtgacccctgactgataaccggctggttccgacccgtcgggccgacgggaccctcggtccaccgtctcctccg

SEQ ID NO: 173130 - DNA, 515 bp, Homo sapiens
  misc_feature: GYAE6OF02G2U6Q.7.76.G10.1.454.CMB.1.raw
  modified_base (324)..(324): a, c, t, g, unknown or other
  misc_feature (324)..(324): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtggggtggcagtcatatcaattgatggagccataaaattttangcggactccgtgaacggtcgattcaccatctccagagacaattccaggaacacactgttctgcaaatgaacagcctgagaattgagactgggtatatactatgtgcccgtcgacccctgactgactaaccggactcggttccgaccccgtggggcccgacgggtacccgtggtaccgaccgtcctcctccg

SEQ ID NO: 173131 - DNA, 512 bp, Homo sapiens
  misc_feature: GYAE6OF02GP1UF.7.76.G10.1.454.CMB.1.raw
  modified_base (324)..(324): a, c, t, g, unknown or other
  misc_feature (324)..(324): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaaattttangcggactccgtgaacggtcgattcaccatctccagagacaatccaggaacacactgttctgcaaatgaacagcctgagaatgaggactcgggtatatactactgtcgcccgtcgacccctgacctgactaaccggactcggttccgacccgtcgggaccgacgggaccctcggtcaccgtctcctccg

SEQ ID NO: 173132 - DNA, 528 bp, Homo sapiens
  misc_feature: GYAE6OF02IAHK4.7.76.G10.1.454.CMB.1.raw
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccagcctgggaggtccctgagactctcctgtgcagcctctggattcaccttcacttcctatgtatttccactcgggtccgccagactccagacgaagggctggagtgggtggcgagtcatatctaattgatggagacctaattaaaattttatgcggactccgtaggaacggtcgattcaccatctcagagacatcagacacactnttcngacaatgaacagctganattgaggacgtcggtatatactacgtagtcgcccgtcgacccctgactagacgtaaccggtctcggttccgaccccgtcgggacgaccgggaaccgtcggtaccgacccgttccgtcctacccg

SEQ ID NO: 173133 - DNA, 520 bp, Homo sapiens
  misc_feature: GYAE6OF02I96EG.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaatttatgcgactccgtgaacggtcgattcaccatctccagagacaattccagaacacactgttctgcaatgaacagcctagagaattgaggtacgtcgggtatatactactgtcgcccgtacgacccctgacctgaactaaccggtactacggttccgacccgtcggggcccgacgggaccctcggtaccaccgtcctcctaccg

SEQ ID NO: 173134 - DNA, 519 bp, Homo sapiens
  misc_feature: GYAE6OF02GI3SS.7.76.G10.1.454.CMB.1.raw
  modified_base (325)..(325): a, c, t, g, unknown or other
  misc_feature (325)..(325): n is a, c, g, or t
tcagcgtgtctctacacgaccggtgctcgatttagtcactcatacagggagaggctcttctgtgtgtagtggttgtgcagagcctcatgcatcacggagcatgagaagacgctcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaattaaaattttangcggactccgtgaacggtcgattcaccatctccagagacaattccaggaacacactgtttctgacaaatgaacagcctagagaattgagactcgggtatatactactgtcgcccgtcgacccctgactgacgtaaaccggacttcggtaccgacccgtgggccgacgggaacccgtggtccgaccgtctacccg

SEQ ID NO: 173135 - DNA, 518 bp, Homo sapiens
  misc_feature: GYAE6OF02IWU7X.7.76.G10.1.454.CMB.1.raw
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (381)..(381): a, c, t, g, unknown or other
  misc_feature (381)..(381): n is a, c, g, or t
  modified_base (505)..(505): a, c, t, g, unknown or other
  misc_feature (505)..(505): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggaggtccctgagactctcctgtgcagcctctggattcaccttcacttcctatgatttccactgggtccgccagacctccagacaaggggctggagtgggtggcagtcatatcaattgatgganccataaaatttngcgactccgtagaacggtcgattcacatctcagagacattccagaacacactgtttcngactaaatgaacagcctagagaattgaggacgtcggtatagtactacgtgtcgcccgtcgacccctgactgaacgtaaaccggcgttacggtccgacccgtgggaccacgggaccctcggtacnccgtctcctaccg

SEQ ID NO: 173136 - DNA, 570 bp, Homo sapiens
  misc_feature: GYAE6OF02G4N90.7.76.G10.1.454.CMB.1.raw
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagacctccagacgaaggggctgggaggtgggtggcagtcatatctaattgatggagacctaattaaaattttangcggtactccgtagaacggtcgatcacatcncaganacaattccagaacactacttgtttctgacaaatacgaacacgtcctagaagtaagttaggaggtacgttacgggtaatacgttactacgtgtccgcccggtccgtaccccgtagtacctacgaacgtaaccggtcgttcggtaccgaccccggtacgggaccgacgggtacccgtacggtacccgaccgttcctccgtaccg

SEQ ID NO: 173137 - DNA, 543 bp, Homo sapiens
  misc_feature: GYAE6OF02G6AG1.7.76.G10.1.454.CMB.1.raw
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccnccagactccagacaaggggctggagtgggtggcaggtcatatcaattgatggagccaataaaattttangcggactccgtgaacggtcgattcaccatctccagagacaattccaggaacacacttgtttctgacaaatgaacagcctagagaattgaggtacgtacgggtattatactacgtgtcgcccgtcgacccctgacctagaactaaccggtacttacggttcccgaccccggtcgggacccgacgggtacccttggtacccaccgttccgtccgtacccg

SEQ ID NO: 173138 - DNA, 593 bp, Homo sapiens
  misc_feature: GYAE6OF02H811A.7.76.G10.1.454.CMB.1.raw
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtactttccactgggtccgccacgactccgagacgaagggctggaggtgggtgcagtcatatctaatgatggagctaattaaatttatgcgtactcgtagtaacgtgattcacatctcagagacattcagaacacactgttcngacaatgaacncgctagagtaagttggaaggtacgtacgggtaattactaacttacgtcgtacgtccccggtcgaacccccgttagaccgttacggtaaccgttaaacccgggtccgttaccgggttacccggaacccccggttacgggggaccccgtaaccggggtaaccccgttcgggtacccctaaccggttccctacccgttacccg

SEQ ID NO: 173139 - DNA, 673 bp, Homo sapiens
  misc_feature: GYAE6OF02I9A75.7.76.G10.1.454.CMB.1.raw
  modified_base (272)..(272): a, c, t, g, unknown or other
  misc_feature (272)..(272): n is a, c, g, or t
tcagcgtgtctctacacgaccggtgctcgatttagtcactcatacagggaggaggctcttctgtgtgtagtggttgtgcagagcctcatcgcatcacggagcatgagaagacgttcccctgctgcccacctgctcttgtccacggtgagcttgctgtagaggaagaaggagccggcgtggtccagcctgggaggtccctgagactctcctgtcgcaggccctctggacttccgcccttcacctttcctatgtattttcccacttgggtcccnccagacctccaagacgaaggggctgggagtggggtggccaggtcatagtcaattgagtggagcctaattaaaagttttgcgacggtactccggtagaacggtcgattcaccatcctaccgagacaactaacttacccgaaggaacactacttcgtttctacgactaaacgtacgaacacgtacctagaagtaagttaggacggtacgttacgggttaattaacgttaacttaacgttcgttaccgtacccggttacccgtaacccccgtacgtaaccgtacggtaaccgttaacccgggtaccgttaccgggttacccggtaccccgggttacggggaccccggtaaccggggtaaccccgttacgggtacccgtacccgttacccgtacccgtaacccgg

SEQ ID NO: 173140 - DNA, 627 bp, Homo sapiens
  misc_feature: GYAE6OF02HCOF6.7.76.G10.1.454.CMB.1.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccnccagctccagacaagggctggagtgggtggcagtcatancaattgatggagccaattaaaattttangcggactccggtagaacggtcgattcaccatcctaccagacgacaattccaggaacacactgtttactgacaaatcgaacacgaccttagaagaattaggacgggtaacgtaccggggttaattaacgttaacttaacgttcgttacggtccccgttacccggaaccccccttgtaacccgtacggtaacgttaaaccccggggtaccgttaccgggtttacccggtaacccccggttacgggggacccgacccggggtaaccccgtccgggttacccgaccccggttccgtccccttaacccg

SEQ ID NO: 173141 - DNA, 530 bp, Homo sapiens
  misc_feature: GYAE6OF02FZ7GI.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggaggtccctgagactctcctgtgcagcctctggattcaccttcacttcctatgatttccactgggtccgccagactccagacaaggggctggagtgggtggcagtcatatcaattgatggagccaataaaatttatgcggactccgtagaacggtcgattcactatctcagagacaattccagaacacacttgtttctgacaaatgaacacgcctagagtaagttgaggacgttcgggtaattactactactgtacgcccgtcgacccctgactgaactaaccggtctcggttccgacccgtcgggaccgacgggacccgtcggtccaccgtcctcctaccg

SEQ ID NO: 173142 - DNA, 519 bp, Homo sapiens
  misc_feature: GYAE6OF02GB8XO.7.76.G10.1.454.CMB.1.raw
  modified_base (319)..(319): a, c, t, g, unknown or other
  misc_feature (319)..(319): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtgcagtcatatcaattgatggagccataaatttngcggactccgtgaacggtcgattcaccatctccagagacattccagaacacactgtttctgacaaatgaacagcctagagtaattgaggactacgggtatagtactactgtgcccgtcgacccctgacctagacgtaaccggcgtcggttccgaccccgtgggacccacgggacccgtggtcctaccgtcctccctaccg

SEQ ID NO: 173143 - DNA, 748 bp, Homo sapiens
  misc_feature: GYAE6OF02H7JEZ.7.76.G10.1.454.CMB.1.raw
  modified_base (173)..(173): a, c, t, g, unknown or other
  misc_feature (173)..(173): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagccgtgggagtccctgagactctcctgtgcagcctcgtggattccaccttcacttcctatcgtatttccacgtcggtccgccagactccagacgaagggctggagtgggtgcagtcatatctaattgagtggacgtacctaaatttaaaatttgtacggtaccggtaccgttaccggtacggaaaccggttcgtaactttccaacctactccgtacccgaaggtaacgtaactaaacgttacccgaaacggtaaacctaaccgtaaccgtttaggttttacctaacggtaacctaaaacgttacggaaaaccgtaacggtacccgttaggaaacgttaaagttacggaacgggtaacgtttaccgggtaaatttacgttaaccgttacgttacggttaccggtacccccggttaccgtaaacccccgttgtaacccgttacggtaaaccggttaaaccccgggtcgttacccgggtttacccggaacccccgggttacggggaccccggtaaccggggtaaccccgtacgggttaccccgtaaccgttccccgttacccgtacccgg

SEQ ID NO: 173144 - DNA, 581 bp, Homo sapiens
  misc_feature: GYAE6OF02GYVGX.7.76.G10.1.454.CMB.1.raw
  modified_base (360)..(360): a, c, t, g, unknown or other
  misc_feature (360)..(360): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtgggtccagcctgggaggtccctgagactctcctgtgcagcctctggattcaccttcacttcctatgatttccactgggtccgccagactccagacaagggctggagtgggtggcagtcatatcaattgatggagccaattaaaattttatgcggtactccgtgaacggtcgatcacatctcaganacaatccagacacactgtttctgacaaatagaacacgcctagaagtaattggacggtaacgtacgggttaattacgtaacttacttcgtacgtccccggtacgtacccccgtgtaccgtacgaacgtaacccggtacgttaccggttacccggtaccccggtacggggacccggtaacgggtaaccccgttcggtacccgtacccgttcctcccgtacccg

SEQ ID NO: 173145 - DNA, 555 bp, Homo sapiens
  misc_feature: GYAE6OF02H33E2.7.76.G10.1.454.CMB.1.raw
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggacttcaccttcacttcctatgatttccactggtccgccagactccagacaaggggctggaggtgggtggcagtcagtatcaattgatggagcctaataaaattttatgcggactccgtgaacggtcgattcaccatcnccagagacaattccaaggaacacactgtttcngactaaatgaacagcctagagaattgaggacgtgggtaatagtaacttacgtgtcgcccgtcgacccctgactgaacgtaaccggtacgttcggttaccggaccccgtacggggacccgtacggggtacccctcgggtacccgtacccggttcctcccgtacccg

SEQ ID NO: 173146 - DNA, 549 bp, Homo sapiens
  misc_feature: GYAE6OF02GQL7A.7.76.G10.1.454.CMB.1.raw
  modified_base (360)..(360): a, c, t, g, unknown or other
  misc_feature (360)..(360): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccattaaaatttatgcggactccgtagaacggtcattcaccatctccaganacaattccaggaacacactgttctgcaaatgaacagcctagaagaattagaggtacgtacgggtataagtactacttgtcgtccgtcgaccccctgtacctgactaaacccggtacgttcggttacccgtaccccggtcgggacccgacggggtaacccttcggtacccgtaccgttcctccctacccg

SEQ ID NO: 173147 - DNA, 512 bp, Homo sapiens
  misc_feature: GYAE6OF02GEZDO.7.76.G10.1.454.CMB.1.raw
  modified_base (376)..(376): a, c, t, g, unknown or other
  misc_feature (376)..(376): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctctggattcaccttcacttcctatgatttccactgggtccgccagacctcagacaagggctggagtgggtgcagtcatatcaattgatggagccataaaatttatgcggactccgtgaacgtcgattcacatctcagacgacattccagaacacactgttcngcaaatgaacagcctagagaatgaggactggtatatactactgtcgccgtcgacccctgactcgaacgtaaccggactcggttaccgacccgtcggggaccgacgggtaccctcggtccacccgtcctcctacccg

SEQ ID NO: 173148 - DNA, 611 bp, Homo sapiens
  misc_feature: GYAE6OF02I2RCH.7.76.G10.1.454.CMB.1.raw
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggngccggngtggtccagcctgggacgtccctgacgtactctccgtgtcgccaggccctcgtaggtacttccacccttcaccttcctagtgtactttccacgttcgggtcccncagtacctccgaggacgaaggggctagggagtgggtgcagtcatatcaagttgagtggactcctaaattaaactttgngacggtactccggtaggaaccggtcacttcaactntccgtacagactactacgttaccgaacgaacactacttcgttctacgtacaactagaactacgtctagtacgtaagttcggacggtacgtacggtactactacgtacgtcgtcgtcccgtcgtacccgtgtaccgtacgtacgtaaccggtcgttacggttccgacccggtacggaccgtacgggtaccgtacggtacccgtaccgtaccgtccgtaccg

SEQ ID NO: 173149 - DNA, 775 bp, Homo sapiens
  misc_feature: GYAE6OF02IYB4G.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggacttcaccttctacttcctattcgtactttccacgtcgggtcccgccgacgacctccaaggacgaaggggctgggaggtggggtggcagtcatatactaagttgagttggacgtacctaaattaaaaatttttagacgtaccggtaaccttccggtacggtaaaccggtcgtaactttacccaacctaactccgttaaacccgaggtaacgaacctaaactttacccgaaacggtaaaccaaccgtactttacgttttacctacggtaacctaaaagtacggaaaacgtaacgtacccgtaaggtaaacgtaaagtttacgggaacggtaacggttaccggggttaaattaacgttaaccttaacgttacgggtacccgttacccgggttaccgtaccccccgttagtaacccgttagtaaaacccggttaaacccgggtccggtttaccggggtttaccccggaacccccgggttacgggggtaacccgtaacccgggggtaaccccgttacgggttaccccgtaccccggtttcccttacccgttaaccccgg

SEQ ID NO: 173150 - DNA, 716 bp, Homo sapiens
  misc_feature: GYAE6OF02IE8C5.7.76.G10.1.454.CMB.1.raw
  modified_base (167)..(167): a, c, t, g, unknown or other
  misc_feature (167)..(167): n is a, c, g, or t
  modified_base (270)..(270): a, c, t, g, unknown or other
  misc_feature (270)..(270): n is a, c, g, or t
  modified_base (355)..(355): a, c, t, g, unknown or other
  misc_feature (355)..(355): n is a, c, g, or t
tcagcgtgtctctacacgaccggtgctcgatttagtcactcatacagggagaggctcttctgtgtgtagtggttgtgcagagcctcatgcatcacggagcatgagaagaccgttccctgctgccacctgctcttgtccacggtgagcttgctgtagaggaagaaggngccggcgttggtccagccgtgggacgtccctggagactctcctgtcgcagtcctcgtaggacttccgaaccttcacttcctatgactttccaacgtgggtccnccagtacctccgagacgaaggggctcgggagtggggtggcagttcatatcgaattcgataggagcctaaattaaaaagtttttanacggacggtaccttaccgtacggaacggttcgaactttcaacccgtattcccgtaccaagtaacgtacaaacgtttcccgaaggaaacctaacgaacgtttcgttttacctacggtaactaaacgtacgaaacgtagacccgttagaacgttaaagttcggtaaacgggtaccgttaccggggtaaatttaacgtaaccgttacgtttacgtccgttaccccggtccgtaaccccccgtagtaaccgttcggtaaaccgttaacccgggtaacgttaccgggttacccggaccccggttacgggtaacccgacggggtaaccccgttcggtacccgtacccggtccgttaccctaacccgg

SEQ ID NO: 173151 - DNA, 760 bp, Homo sapiens
  misc_feature: GYAE6OF02G074L.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtactttccacgtcgggtcccgccacgacctccaggacgaaggggctagggagtgggtcggcagtcagtatctaattgagttggacgacctaattaaaatttataggcggtacgtccgtagtaacggtcgaacttcgaacctatcctaccgagtaacgaactaacgttaccgaacgggtaaacctaaccgtacttacggtttactacggtaacctaaaagtacgaaacgtacgtacccgttaggaaacgttaagttacgggaacggtaacggtacgggtttaaacttaacgttaaccgttaaccgttacggtaccggttaccccggttacccggtaacccccgttacgtaacccggttacggtaaacccggtttaaaacccggggtacccggtttaaccggggtttaacccccgggtaacccccgggttacccgggggtaaccccgggtaaaccggggtaacccccgttaccggggttaacccccggtaccccggtttacccgttaccccgttaaccccgg

SEQ ID NO: 173152 - DNA, 629 bp, Homo sapiens
  misc_feature: GYAE6OF02H7J0M.7.76.G10.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgcccacctgctcttgtccacggtgagcttgctgtagaggaagaaggagccggngtggtccagcctgggagtccctgagactctcctgtgcagcctctggattccaccttcacttcctatgtatttccacgtgggtccnccagactccagacgaagggctggagtgggtgcagtcatatctaattgatggacactaaattaaaatttntgtcggtactccggtagaacggtcgattccacctatcctaccaagtacgactaacttaccaacggaacctaactacttgtttactagaacctaaatacgaaaccgtacgtacctagtaacgtaagttaggaacggtacgttacgggttaattaacgtaacgttacgtacgttccgtacccgtacgtaccccctagaccgttacgtaacgtaaacccggtcgttaccggttacccggtaccccggtacgggacccgaccgggtaacccgtccggtacccgtaccgttacccgtcctaccccg

SEQ ID NO: 173153 - DNA, 771 bp, Homo sapiens
  misc_feature: GYAE6OF02I9LTR.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtcccacggtgagcttgctgtagaggaagaaggagccggcgtggtccagcccgtggggacggtccctgagacctctcctgtgcagcctcgtggattccaccttcaccttcctatgatttccactgggtccgccacgactccagacaagggctggaggtgggtggcaggtctatatctaattgatggagacctaattaaaattttatgcggtacttccggtaggtaacggtcgtattcaaccgtactctaccagacgactaacttacccgaaggaacaccgtacttacgtttctacggtactaaaactacgaaacgtaacggtccctaggtaacgtaacgtttacgggtaaacggtaccggttaaccggggtttaattaacgttaaacccgtttacgttaccggttacccgggtaccccgttacccggttaaacccccccgttacgggtaaacccgttaacggtaaaccggttaaaacccccggggttaaacccggttttacccggggttaccccgggtaacccccccgggttacgggggggaacccccggttaaccggggggttaacccccccgggtttacggggttaacccccgttaaccccgggtttcccccggttaaccccgttaacccccggg

SEQ ID NO: 173154 - DNA, 640 bp, Homo sapiens
  misc_feature: GYAE6OF02GZ939.7.76.G10.1.454.CMB.1.raw
  modified_base (256)..(256): a, c, t, g, unknown or other
  misc_feature (256)..(256): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccnccagacctccagacgaaggggctggaggtgggtggcagtcatatcaattgatggagacctaattaaaattttatgcggaactccggtagaacggtcgtaattcaaccgtatcctaccgagacgactaacttacccaaggaaccactacttgtttcagtacaaagtcgaaacagtccctagtaagtaagtttacggaggtaaccgttcgggtaattaacgttaacttacgtggttaccgtccccgtaccgtaacccccgttgaaccttacggtaaacgtaaacccgggtacgttaccgggttacccgaacccccggttacgggggaccccgtaacggggtaacccccgttagggtacccgaccccggttaccgtcccctacccgg

SEQ ID NO: 173155 - DNA, 687 bp, Homo sapiens
  misc_feature: GYAE6OF02JR884.7.76.G10.1.454.CMB.1.raw
  modified_base (173)..(173): a, c, t, g, unknown or other
  misc_feature (173)..(173): n is a, c, g, or t
  modified_base (261)..(261): a, c, t, g, unknown or other
  misc_feature (261)..(261): n is a, c, g, or t
  modified_base (333)..(333): a, c, t, g, unknown or other
  misc_feature (333)..(333): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagcctgggagtccctgagactctcctgtgcagcctgtggacttcaccttcacttcctatgtactttccacgtcgggtcccncagacctcagacgagggctggagtggtgcagtcatatcaagttgatggacgtactaaagtttaaaagtttgnggaccggtactccggtaggtaaccgttcgacttccaaacgtacttacgaccgaaggaacgtacctaacgttaccgaaggaaacctacgtaacttcgtttactacgtaactaaacgtacaacgacgtaccgtagtaaacgtaacgttacggaacggttaacgttacgggtaacttaactaccgttaacgtcgtacccggttaccccgtacggtaacccccgttagtaaccggttacgtaaaccggttaaaccccgggtacgtttacccgggttaacccggtccccgggttaaggggaccccggtaacgggttaccccggtacggtacccgtaaccccggttacgtccccgtaccg

SEQ ID NO: 173156 - DNA, 531 bp, Homo sapiens
  misc_feature: GYAE6OF02HECCP.7.76.G10.1.454.CMB.1.raw
  modified_base (325)..(325): a, c, t, g, unknown or other
  misc_feature (325)..(325): n is a, c, g, or t
  modified_base (390)..(390): a, c, t, g, unknown or other
  misc_feature (390)..(390): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctctggattcaccttcacttcctatgatttccactgggtccgccagactccagacaaggggctgggagtgggtggcagtcatatcaattgatggagccaattaaaattttangcgactccgtagaacggtcgattcacatctaccagacgacaattccaggaacacacttgtttacngacaaatgaaacacgacctagaagtaattgaggacgtacgggtatatactactgtcgcccgtcgacccctgactgactaaccggacttcggtaccgacccgtgggaccgacgggaccctggtccacccgtcctccgtaccg

SEQ ID NO: 173157 - DNA, 693 bp, Homo sapiens
  misc_feature: GYAE6OF02JEWAG.7.76.G10.1.454.CMB.1.raw
  modified_base (167)..(167): a, c, t, g, unknown or other
  misc_feature (167)..(167): n is a, c, g, or t
  modified_base (265)..(265): a, c, t, g, unknown or other
  misc_feature (265)..(265): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagccgtgggacgtccctgagactctcctgtgcagcctcgtggtacttcaccttcaccttcctatgtactttccacgtcgggtccnccgacgactccaagacgaacggggtctgggaggtgggtggcagtacatactctaattgagtggagtacctaattaaaagtttagacgtaccggtaccgttccggtaggtaaccggtctaacttccgaacctatccttaccgaggaacgtactaacttaccgaacggtaacctactaccgttcgtttactacgtaactaaacgggggtaactaaccgtaacgtaccgtagtaagtaacgtaacggtaacggtaacgtaaccgggttaattaacgttaaccgttaccgttacggtccgtacccgtaccgtaccccgtacgtacctacgtaacgtaaaccgggtcgttacggttacccggtaccccggtaccgggaccggtaccgggtaacccgttaccggtaccgtacccggtaccgtacccgtacccgg

SEQ ID NO: 173158 - DNA, 629 bp, Homo sapiens
  misc_feature: GYAE6OF02JXRYZ.7.76.G10.1.454.CMB.1.raw
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggaggtccctgagactctcctgtgcagcctctggacttcaccttcacttcctatgtatttccactgggtccnccagactccagacaaggggctggaggtgggnggcaggtcatatcaattgatggancctaattaaatttgagacgtactccgtagaacggtcgtattaacactactactccaagtacgactaacttccgaaggaacaactacgttagttcctagaactaaactanaaacgtacgacctagacgtaaacttggaaggtaacgtagggtaacttaacgtactaacgttcgtaccgtcccgtaccgaccccgtacgtacgtacgtaacgtaaacccggggtacttacgggttacccgtaaccccgggtacgggtacccggtaacgggtaaccccgttcgggtacccgtaaccccggttccgtccccgtaaccgg

SEQ ID NO: 173159 - DNA, 568 bp, Homo sapiens
  misc_feature: GYAE6OF02JEBNR.7.76.G10.1.454.CMB.1.raw
  modified_base (323)..(323): a, c, t, g, unknown or other
  misc_feature (323)..(323): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaagggctggagtggtggcagtcatatcaattgatggagcctaattaaattttangacgtactccgtagaacggtcgattcacatctcagacacataccaggaacactactgttctgacaaatgaacagcctagacgaagttacgaggtacgtacgggttaactagttaactacgtagttccgcccggtacgtacccccgtagacctacgaacgtaaccggtcgtacggttcccggtaccccggttcgggacccggtacgggtacccgtacggtacccgtacccgtaccgtccgtacccg

SEQ ID NO: 173160 - DNA, 569 bp, Homo sapiens
  misc_feature: GYAE6OF02G10B1.7.76.G10.1.454.CMB.1.raw
  modified_base (257)..(257): a, c, t, g, unknown or other
  misc_feature (257)..(257): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtatttccacgtggtccnccagactccagacaaggggctggagtgggtggcagtcatatcaattgatggacgacctaattaaaattttatgacggtaccttccgtaggaacggtctattccaaccgtactcctccagagacaattccaagaacactactcgttctagacaaatagaacagcctagactaagtagaggtacgtaggtatacgtactacgtagtcgtcccgtacgaccccgtagtacctagtaacgtaaccggacgttacggttaccggaccccgtcgggaccggacggaccggtccggtacgtacccgtccgtcctacccg

SEQ ID NO: 173161 - DNA, 767 bp, Homo sapiens
  misc_feature: GYAE6OF02GHDJL.7.76.G10.1.454.CMB.1.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctcgtggacttccaccctttcacttcctatgactttccactgggtccgccagactccagacgaagggctggagtgggngcagtcatatcaattgagtggagacctaagttaaaattttagnggaccggtactccggtaggtaaccggttcgtaagtttacccaacctacttcctaccgaacgaacgtacctaaacttacccgaaagggaaacccaactaaccgtttaggttttacctacggtaaacctaaaacgttacggtaaaaccgaaccggtacccgttaaggtaaagttaaacggtttacggaacggggtaacccgtttaccgggggttaaatttaaccgtttaaaccgttaacgttcgggttaccgtaccccggttacccggtaaccccccgttagtaacccgttaggtaacccggttaaaacccgggtaccgtttaccggggttaccccggtaaccccccgggttacgggggtacccccggtaaacccggggttaccccggttaccgggttaccccggtaccccggttcccgttacccgtaccccgg

SEQ ID NO: 173162 - DNA, 661 bp, Homo sapiens
  misc_feature: GYAE6OF02GNIQK.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggagtccctgacgactctcctgtgcacgcctcgtggtacttcacccttcaccttcctatgtactttccacgttcgggtcccgccacgacctaccaggaaccgaagggggtcctgggaggttcggggtgcctacggtacatatactaagttgagtggacgacctaatttaaaattttgagccggtacttaccggtaggaacggtcgtaattccgaccctattcctacgagaacgtaactaacgttaccgaaggaaacctacgtaccctttgttacctacggaactaaagtacgaaactaccgtcctaaggaacgtaagttaggagggtacgtcggtaatacttacgtacgtgtaccgcccgtaccgtacccctgacctacgtaacgtaaccggtcgttaccgggtacccgtccccggtacggggacccgtaaccgggtacccgtccggttacccaccggttaccctccgtacccg

SEQ ID NO: 173163 - DNA, 573 bp, Homo sapiens
  misc_feature: GYAE6OF02HDTKN.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacctttcctatgtactttccacgtcgggtccgccagacctccgagacgaaggggctgggaggtgggtggcagtcatatcaattgatggactacctaattaaaatttagtgtacggactcgtaggacggtactacttacacctatccacgagaagactaacttccgaaggaacactacttgttctacgactaaatacgaacagtcctagagtatggaggtactaggtatactactacgtgtaccgtccctcgtaccctagactcgtaacgtaaccggtcgttcggttccgacccgtcgggaccgtacgggtacccgtcggtaccgtacccgttcctaccctccg

SEQ ID NO: 173164 - DNA, 578 bp, Homo sapiens
  misc_feature: GYAE6OF02F2HXX.7.76.G10.1.454.CMB.1.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
tcagcgtgtctctacacgaccggtgctcgatttagtcactcatacagggagaggctcttctgtgtgtagtggggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctctggattcaccttcacttcctatgacttttccactggtccgccagacctccagacgaagggctggagtgggtggcagtcatatcaattgatggacnccaattaaatttncgcgtactccggtgaacggtctattccaccgtatctacccagacgaactaattaccaagaacacactcgttcagtacgtaaatgaacacncgttagaagtaagttgaacggacttcgggtatacgtacttacgtgtcgtacccgtcgtacccctagtaccgtacgaacgtaaccggtcgttaccgggttaccggaccccgtcgggacccgacgggtaacccgtcggtacccgacccggtacctccgtacccg

SEQ ID NO: 173165 - DNA, 742 bp, Homo sapiens
  misc_feature: GYAE6OF02HJHOX.7.76.G10.1.454.CMB.1.raw
  modified_base (272)..(272): a, c, t, g, unknown or other
  misc_feature (272)..(272): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccacggtgagcttgctgtagaggaagaaggagccggcgtggtccagccgtggggacggtccctgacgactcctcctgtgccagcctctggacttccaccttcacctttcctattgtatttccacgtcgggtccnccagacctccagacgaaggggctgggacggtggggtggctaggtcattactactaattggagtggacgtaccctaaatttaaaattttatcggtacggtaccgttccggtacggtaaaccggttcgtaactttccaaccctacttccctacccgaagaaccgtaacctaacgtttacccgaacggtaaaccctacgtaccgtttacgtttaccgtacgtaactaaacgtacgtaaaccgacgtacccgtagtaacgtaaacgttaggaacgggttaccggttacgggttaattaacgttaaccgttacgttacgttaccggtaccccgttacccgtacccccgtagtaaccgtacgtaaccggtaacccgggtaacgttaccgggttaccccggtacccccggtacggggacccggtaacccgggtaccccggttccgggtaccccgtacccgttcccgtcccgtacccg

SEQ ID NO: 173166 - DNA, 662 bp, Homo sapiens
  misc_feature: GYAE6OF02HZPHF.7.76.G10.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (350)..(350): a, c, t, g, unknown or other
  misc_feature (350)..(350): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgcctcttcgtccacggtgagcttgctgagaggaagaaggagccggcgtggaccagccgtgggagtccctgagactctcctgngcacgtctcnggatccacttcgacttctatgtatttccacgtcgggtaccgccaacgactccgagaacgaaggggctgggtaggtgggttggcgtacgtcaatatacgaaagttgagtggacgacctaatttaaaatttncggtacgacgtacgtaggaaacgtcgtaattcaacctatccgtaccaagtaagaacaactacgaacgaaacacaacgttcgttactacgaagtaacgtaacgaacgacgtacgtagtaagtaagtaggtaacggtaacgttacgggtaaattaacgtaacgttaccgtcgtaccgtaccccgtacgtaacccccgtagtaccgtacggaaccgtaaaccgggtaacttccgggttacccggtaccccggtaccggggtacccggaaccgggaccccggttacgtacccggtcccgtaccgttacccgtccgg

SEQ ID NO: 173167 - DNA, 613 bp, Homo sapiens
  misc_feature: GYAE6OF02IVZ4Y.7.76.G10.1.454.CMB.1.raw
  modified_base (174)..(174): a, c, t, g, unknown or other
  misc_feature (174)..(174): n is a, c, g, or t
  modified_base (267)..(267): a, c, t, g, unknown or other
  misc_feature (267)..(267): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggagccggngtggtccagccgtgggacgtccctgacgactctcctgtgcacgcctctggtacttccaccttcaccttcctatgactttccacttgggtcccnccagaccgtccacgacgaacggggctagggaggtgggtggcagtcatatcaattgatggagacctaattaaaattttatggacggtacttccgtaggaacggtcgattacaccatctaccagagactaacttaccgaaggaacactcttagtttctcgaacaaattacgaacacgtactagaataagttggacggtaccggttcggtaacttactaacgttacgttcgtccgtaccgttcccgacccgtgtaccgtagtaaccgtaaccggtcggttaccggtacccggtacccgtacggggacccgaaccgggtacccgtcggtaccctccgttcctcctacccg

SEQ ID NO: 173168 - DNA, 736 bp, Homo sapiens
  misc_feature: GYAE6OF02IN1V3.7.76.G10.1.454.CMB.1.raw
  modified_base (266)..(266): a, c, t, g, unknown or other
  misc_feature (266)..(266): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggaggtccctgagactctcctgtcgcacgcctctggtacttccaccttcacttcctatgtactttccacgtcgggtccnccacgacctaccgagacgaacggggtctagggtaggttggggtcggacgaggtactaatatactaagttgaagttagggaacgtacctaaaattaaaatttttagtacggtaccggtaaccttaccggtaggtaaaccggtcgtaacttaccaacctactaccgtaccgaagtacgtaaactaaccgttaccgaaacggaaacctaacctacgttacgttttaccgtacgtaactaaacgttacgaaaccgtacgtaccgtaaggtaaagttaaagttacgggaacgggttaaccggtaacgggttaaattacgtaaacgttaccgttcgttaccgtaccccggtaccgtaccccgtagtaccgtacgtaacgttaacccggtaacgttaccggttacccggtaccccggtacggggtacccgtaaccgggtacccgttcggtacccgtacccgttcccgtcccgtaccg

SEQ ID NO: 173169 - DNA, 749 bp, Homo sapiens
  misc_feature: GYAE6OF02JT7VE.7.76.G10.1.454.CMB.1.raw
  modified_base (141)..(141): a, c, t, g, unknown or other
  misc_feature (141)..(141): n is a, c, g, or t
  modified_base (194)..(194): a, c, t, g, unknown or other
  misc_feature (194)..(194): n is a, c, g, or t
  modified_base (260)..(260): a, c, t, g, unknown or other
  misc_feature (260)..(260): n is a, c, g, or t
  modified_base (409)..(409): a, c, t, g, unknown or other
  misc_feature (409)..(409): n is a, c, g, or t
  modified_base (551)..(551): a, c, t, g, unknown or other
  misc_feature (551)..(551): n is a, c, g, or t
tcagcgtgtctctacacgaccggtgctcgatttagtcactcatacagggagaggctcttctgtgtgtagtggttgtgcagagcctcatgcatcacggagcatgagaagacgttccctgctgccacctgctcttgccaggtnagcttgctgtagagaagaggagccggcgtggtccagccgtgggggacgtcccnggagtacctctccgtgtcggcaggccctcgtcggtattacccaccctttcaaccgtttcctacgtntctttccaccgttgggtcccgaccaggtaccctacgacgaaccggaaaggggtccgtagggtacggtcggggttcggcgtaacggttacaacgttacggttactaaagttggaccgttaggcgtaacctaaagtttaaaacttttacgnggtaccggtaccgtaccggttacgggaacggtttaccatttacccgaacctattaccgaccccgaaagtaccgaaactaaacgttcccgaaaggtaaacctactaacgtttggttacctacggaactaaagtcgaacgtacncccgttaagaataagttcggaaggttaccggtaggttacaaccgttaacgtcgttacggtaccgcccgttaccgaccccgtagtaccgtacggtaaccgtaaccggtaccggtttgggtaccccaacccgggtcggtaccgggttaacccggtaccccggttacgtaacccgggtacccgtttccccgagtaccccgg

SEQ ID NO: 173170 - DNA, 539 bp, Homo sapiens
  misc_feature: GYAE6OF02FQKMG.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcgatatcaattgatggagtccaataaaattttatgcgactccgtgaacggtcgattcaccatctcagagacaattccaggaacacacttgttctgacaaatgaacacgcctagagaattgaggactacggggtatactaactactgtgcccgtcgacccctgactagacgtaaaccggtactacggttcccgacccgtcggggacccgacgggtacccgtcggtaccacccggttcctccctacccg

SEQ ID NO: 173171 - DNA, 693 bp, Homo sapiens
  misc_feature: GYAE6OF02I75JO.7.76.G10.1.454.CMB.1.raw
  modified_base (167)..(167): a, c, t, g, unknown or other
  misc_feature (167)..(167): n is a, c, g, or t
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagcctgggacggtccctgagactctcctgtgcacgcctcgtggacttccaccttcacctttcctatgtactttccacgttcgggtccnccagacctccagacgaaggggctgggaggtgggtggcagtcatatacaattgagtggacgacctaattaaaattttgngaccggtactccggtagaacggtcgacttcactactcctaccaagacaactaacttaccgaaggaacctactacgttgtttcctagtactaaacgtcaaacgtacgaccttagaacgtaagttaggacggtacgttagggttaattacgtaacttacgttacggtccgtaccccgttaccgaaccccgttagtaacccgttacggtaaaccggttaaacccggtaccggtttacccgggttaccccggtaaccccccggttacgggggtaacccccggaacccgggggttaaccccgttaccgggttacccgtaacccccgggtttacccttaccccgttaacccgg

SEQ ID NO: 173172 - DNA, 777 bp, Homo sapiens
  misc_feature: GYAE6OF02IU4IM.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtcccagccgtgggacggtccctgacgactctcctgtgcacgtcctcgtggacttccaccttcaccttcctatcgtacttttccacgttcgggtcccgccacgacctccgaaggacgaacggggctgggaggtgggtggcaggtcatactctaattgagtggacgtacctaaattaaaattttagacgaccggtacgttaccggtaggtaacggttcgtacttaccgaacctactacctaccgaagtaacgtaactaacgtttacccgaaggtaaaccaaccgtacgtttacgttttacctaacgtaacctaaaacgttacgaaaccgtacgtacccgttaggtaaagttaacgtttacgggaaagggtaccgtttacgggttaaactttaacgtttaaccgttacggttccgttaccggtaccccggttacccgtaacccccgtaggtaccgttacggtaacccggttaaaccccgggtcgtttaaccggggttaccccggtaaccccgggttaccggggggtaaccccgttaacccgggggtaacccccgtttccggggtaaccctacccccgggtttaccttacccccggtaacccgg

SEQ ID NO: 173173 - DNA, 783 bp, Homo sapiens
  misc_feature: GYAE6OF02GUAJP.7.76.G10.1.454.CMB.1.raw
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggacggtccctgagacctctcctgtgcagcctntggattccacttcacttcctatgtactttccacgtcgggtcccnccagacctccaagacgaaggggctagggaggtgggtggacaggtccatactactaattggagtgggacaccttaaatttaaaattttcgtcgtaccggtaccttccggtaggtaaaccggttcgtaattccaaccgtattacccgtaccgaagtaaccgtaactaaccgttaccgaaacggtaacccaacttaccgtttacggttttaccacggtaactaaaacgtaccggtaaacctaacggtaccgttaacggaaagttaaaggttacggtaaacggggttaaccggttacggggtaactttaaccgttaccggttaccgttacggttcccggtaccccggttacccgtaacccccgttagtaaccggttacgtaaacccgggtttaaacccgggtaccggttacccggggtttaaccccggtaaccccgggttacccgggggtaacccggtaacccggggttaaccccgttccgggttaccccgtaaccccggtttccccttacccggttaccccg

SEQ ID NO: 173174 - DNA, 584 bp, Homo sapiens
  misc_feature: GYAE6OF02GJUOH.7.76.G10.1.454.CMB.1.raw
  modified_base (259)..(259): a, c, t, g, unknown or other
  misc_feature (259)..(259): n is a, c, g, or t
  modified_base (330)..(330): a, c, t, g, unknown or other
  misc_feature (330)..(330): n is a, c, g, or t
  modified_base (479)..(479): a, c, t, g, unknown or other
  misc_feature (479)..(479): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacgtccctgagactctcctgtgcagcctctggattccaccttcacttcctatgactttccactgggtcccnccagactccagacgaaggggctgggagtggggtgcagtcatatacaattgatggagaccaattaaaatttnggtacgtactccgtaggaacggtctacttccacactctccagacgactataccgaaggaaccactacttgtttcacgactaatacgaacacgcctagatagtgacgtacgtggtatataacttgtcgtccgtcccgtacgtaccccgtnaccgtagaaccgtaaccggtacttaccgggttacccggaccccggtcgggaacccggtaccgggtacccgttcgggtacccctacccgttcccgtccctacccgg

SEQ ID NO: 173175 - DNA, 875 bp, Homo sapiens
  misc_feature: GYAE6OF02JUAQ2.7.76.G10.1.454.CMB.1.raw
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccactgctctgtccacggtgagcttgctgtagaggaagaggagccggngtggtccagccgtggggacgtcccngagtacctctcctgtcgcagccttnggtattccaccttcacttcctatcgtacttccgtactcgggtaccgtccgacgtaccgtccaacggacgaaacgggggtcgtacggggtaacgggttggggtcgggtaccgacgggttacaacgttagttacctaaaggttttagaacggtcggggtaactacccgtaaaatttaaaacgttttaacgttacgggtacccggttaccggtaccgtttacgggtaacgggttaccgtaacgtttacccgaacctaccgtaccttacccgtagggtaacgtaaccttaaccgtaccgtaaaccggtaaaccgtaccgtaacggttacgtttccgttaacgtaccgtaaactaacggtaaaccggacctaaccggttacggttaaacggtaaacgtttacgggtaaacggttaacccgggtttacggggtaaactttaaccgttacctttaaaccgggtaccgttccgggttacccccgttaaccggtaccccgtaacggtttacccgaacggtaaacggttaaccccggtaacccggttttaacccgggtcccggggttaaaccccccgggttccggggtaaccccgtaccggggggttaacccccgtttcgggtaacccccgggtacccgttaccccggttacccggtaaccccgg

SEQ ID NO: 173176 - DNA, 697 bp, Homo sapiens
  misc_feature: GYAE6OF02I4MI2.7.76.G10.1.454.CMB.1.raw
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggagccggcgtggtccagccgtgggacggtccctagagcctctcctggtgcagtcctcgtggtacttccaccttccactttcctatgtactttcacgtcggtccnccagacctccgagacgaggggctggagtgggcgcagtacatanactaattgagtgganactaaattaaaatttgacgacggacttccgtagtaaccggctattaccacgacttccgtacgaacgaacgaacctaactaccgaacggtaactaacctacgttacggtttacctaacggtaaccttaaacgtagtaaaccgtacggtaaccgtacggtaagtaacgttacggtaacggtaacgttacgggtaaattaacgttaccgtaacggttccgttaacgtccccgtaaccgtacccccgtagaccgttacgaaaccggttaaccggtacgttaaccgggttacccggtaacccggtaccgggtaccccgtaaccggggttaccccgtaccgggtaccctacccggtacccttacccgtaacccgg

SEQ ID NO: 173177 - DNA, 688 bp, Homo sapiens
  misc_feature: GYAE6OF02JBTQA.7.76.G10.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggngtggtccagccgtggggagtccctggagacctctcctgtgcagcctntggattccaccttcaccttcctatgtactttccgacgtcgggtcccncctagtacctaccgaaggacgaaggggtcctagggacggtggggtcgacaggtcaatactactaagttggaagttgggaactcctaaaatttaaaagttttgcggaccggtaacgtccggtaggaaacggttcgtaacttaccaaccgattccaccgtaagaacgtacgtaacttaaccgacggtaaacctactacgttagtttactacgtaactaaagtacgtaacacgtacgtacgtaagtaagtaggacggtacgttaacgggttactaacgttaacgttacgtacgttaccgtcccgtaccgtaaccccgtacgtaaccgtacgtaacgtaacccggtacgtaccgggttacccgaacccggtcgggacccgtaaccgggtacccgtccgtacccgtacccgttacctcccgtaccg

SEQ ID NO: 173178 - DNA, 723 bp, Homo sapiens
  misc_feature: GYAE6OF02IZTSX.7.76.G10.1.454.CMB.1.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacgtccctgagactctcctgtgcagcctntgattccaccttcacttcctatcgtatttccgacgtcgggtcccnccacgacctccagacgaaggggtctgggaggtgggtggcgagtcatactctaattgagtggacgtactaaattaaaatttgtggaccgtacgtccggtacggtaacggtcgtaattccaacctactcctaccagtaacgaactaaccgttaccgaacggtaaaccaccgtaacgtttcgtttccgtacgtaactaaacgtacgaaactacggtaccttaaggaacgttaacgttaggacgggtaacgtttaacgggtaatttaacgtaaccgtttacgtacggttacccggtcccttaaccccggtacccccgttaggtaaccgttaccggaaaccggtttaaacccgggtaccggttaccgggttaaccccgggtccccgggttacccggggaacccgtaacccgggggttaacccgtccggttacccggtaccccggttcccgtaccccgttaacccgg

SEQ ID NO: 173179 - DNA, 538 bp, Homo sapiens
  misc_feature: GYAE6OF02HN48G.7.76.G10.1.454.CMB.1.raw
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgtatttccactgggtccgccagactccagacaaggggctggagtgggtggcagtcatatcaattgatggagcaattaaatttangcgactcgtgacgtcgatcacatctcaganactatccaaggaacacactgttctagacaaatgaacacgcctagagtaattggaggacgtacgggtatatactatgtcgtcccgtcgacccctagactacgaacgtaaccggcgtacggttcccgtacccgtcggggacccgtacgggtaacccgtcggtacccgtacccgtcctcccgtacccg

SEQ ID NO: 173180 - DNA, 825 bp, Homo sapiens
  misc_feature: GYAE6OF02FFPYZ.7.76.G10.1.454.CMB.1.raw
  modified_base (173)..(173): a, c, t, g, unknown or other
  misc_feature (173)..(173): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagcctgggaggtccctgacgactcctcctgtgcacgcctctggattccaccctttcactttcctatgactttccacgtgggtccnccagtactccagacaaggggctgggagtggnggcagtcatatcaagttgagtggacgccaaagtttaaaattttgacggccgggtacttccgttaggaaccggttcgtattccaaccgtacttccgtacccagaacgtaacctaaaccgtttaccgaacggaaaccaacgtaacgtttacggtttaccgtgtaaccctaaaagtacggtaaaccgacggtacccgtaaggtaaccggtaaagtttacgggtaacgggtaaaccgtttaaccgggggttaaactttaacgtttaaacccgtttaaccgtttacggttacccgggtacccccggtttaacccgtaacccccccgttaacggtaaccccgtttacggtaaaacccggttaaaaccccggggttaaaccgggtttaccccggggtttaaacccccgggttaacccccccgggttaccgggggggtaacccccgttaaaccggggggttaaacccccccggttaaccggggtttaccccccggtaacccccggtttaccccggttacccccgtttaacccccggg

SEQ ID NO: 173181 - DNA, 695 bp, Homo sapiens
  misc_feature: GYAE6OF02IEJSR.7.76.G10.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (407)..(407): a, c, t, g, unknown or other
  misc_feature (407)..(407): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaagggagccgggcgtggtccagccgtggggacggttcccngagactctcctggtgcagcctctggattccacttcacttcctatgacttccacgtggtccnccagactccagacgaaggggctggagtggggtcgngtagtcatagtacaattgatcggagcctaaattaaaaacttttntacggtacgggaaccttaccggtaggtaaaccggttacgtaatttcccgaacccttacgttaccncccgtaaaggaccggtaaacaaaccgttttccgaaaacgggaaaccctaacctaaccgtttcgttttaccgtacggtacctaaaagttaacggaaacgtaaccgtccgttaaggaagttaaacgttagaacgggtacgttacgggtaaatacgtaactaccgtagtcgtacccgcgtaaccccttgacgtacgtaacgtaacccggtacgttacggttccgaaccccggtggggtaccccgtaaggggtacccgtccggttacccgtaccggtacttcccgtaacccg

SEQ ID NO: 173182 - DNA, 554 bp, Homo sapiens
  misc_feature: GYAE6OF02FGJAB.7.76.G10.1.454.CMB.1.raw
  modified_base (290)..(290): a, c, t, g, unknown or other
  misc_feature (290)..(290): n is a, c, g, or t
  modified_base (541)..(541): a, c, t, g, unknown or other
  misc_feature (541)..(541): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctggggaggtccctgagactctcctgtgcagcctctggattcacctttcacttcctatgactttccacttgggtccgccagacctccagacaaggggctggagtggngcagtcatatcaattgatggacgcctaattaaaatttatgccggacttccgtaggaacggtcgattcaacctatcctaccagacgactaacttccaacggaaccactacttacgtttctagactaaatagaacagacctagacgtaagttgaggtacgttacgggtatagtactacgtgtcgcccgtacgacccctgtactgaactaaccggtctcgtccgacccgtcgggaccgacggtaccctggtccnccgtctcctaccg

SEQ ID NO: 173183 - DNA, 739 bp, Homo sapiens
  misc_feature: GYAE6OF02FOWLX.7.76.G10.1.454.CMB.1.raw
  modified_base (167)..(167): a, c, t, g, unknown or other
  misc_feature (167)..(167): n is a, c, g, or t
  modified_base (218)..(218): a, c, t, g, unknown or other
  misc_feature (218)..(218): n is a, c, g, or t
  modified_base (334)..(334): a, c, t, g, unknown or other
  misc_feature (334)..(334): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagcctgggacggtccctgagactctcctgtgcagcctntggattccaccttcacttcctatgtactttccacgtcgggtcccgccagacctccagacgaagggctgggagtgggtgcagtcatatcaattgatggagacctaaattaaaatttnacggccggtacttccggtaggtaaccggtcgtacttaccacctacttcctaccgaagacgaaccttaacgttacccgaaacgggtaacctaacgtaaccgtttcggttttacctacgtaacctaaaagttacgaaaccgtacggtaccgttaaggaaagttaaagttacggaaacgggttacggttaacgggttaacttaacgttaaccgttaccgttcggttacccggtaccccgttacccgtaacccccgttagtaacccgttacggaaacccggttaaacccgggtaccgtttacccggggttaccccggtaacccccgggttccgggggtaaccccggtaacccggggtaccccgttaccgggtaccccgtaccccgtttacccgtccccgttaaccccgg

SEQ ID NO: 173184 - DNA, 628 bp, Homo sapiens
  misc_feature: GYAE6OF02FX3IR.7.76.G10.1.454.CMB.1.raw
  modified_base (333)..(333): a, c, t, g, unknown or other
  misc_feature (333)..(333): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctcgtggacttccaccttcaccttcctatcgtatttccacgtcgggtccgccagacctccagacaggggctggagtgggtgcagtcatatcaattgatggagacctaattaaaattttnggcggtactccggtagaaccggtcgtacttcacctatcctaccagacgactaacttaccaaggaaccactacgttgttctacgaactaaatgaaaccacgccttaggaagtaacgttggaaggtacgtacgggtaattaacgttaccttacgttcggtaccgtaccccgttaccgacccccttagaccttacgaaccgtaacccgggtccgttaccgggttacccggaccccggttacggggacccgaacggggttacccctacgggttacccaccccggttcctcccgtacccg

SEQ ID NO: 173185 - DNA, 828 bp, Homo sapiens
  misc_feature: GYAE6OF02I42CO.7.76.G10.1.454.CMB.1.raw
  modified_base (195)..(195): a, c, t, g, unknown or other
  misc_feature (195)..(195): n is a, c, g, or t
  modified_base (499)..(499): a, c, t, g, unknown or other
  misc_feature (499)..(499): n is a, c, g, or t
tcagcgtgtctctacacgaccggtgctcgatttagtcactcatacagggagaggctcttctgtgtgtagtggttgtgcagagcctcatgcatcacggagcatgagagaccgttccctgctgccacctgctcttgtccacggtgagcttgctgtagaggaagaaggagccggcgtggtccagccgtgggagtcccngagactctcctgtgcacgtcctctggtattcaccttcacttcctattgtacttccacgtcgggtcccacctagacctaccagacgaacgggggtctagggaggtcgggtggactacgtacattaactctaaagtttgagtaggacgtacctaaaagttttaaaactttgtacgggtaccgtaccgttaccgggtaacgtaaccgggttctaactttccgaaccctattacccgtaccgaagaacggtaacctaaacgttccgaacggtaaacctaacgtaacgtttacggtttacacggttaanaaaaccgttacgaaccggtacgtaccggttaaataacgggttaacgtaagggtacgggttaacccgttaacggggtttaaacctaacggtttaaacccgttaacgttaaccgggtcccggtaaccccggtttaccccggtaacccccgtttaaaggtaaccgttaccgggtaaaaaccgggtttaaaccccccgggtaacggttttaccccgggggttaccccaaacccccggggttaccggggtaaccccgttaaaaccccgggggttaccctttaaccccggggtccccgtaaaccccggtttcccccggttaccctaaccccgggg

SEQ ID NO: 173186 - DNA, 745 bp, Homo sapiens
  misc_feature: GYAE6OF02II7CE.7.76.G10.1.454.CMB.1.raw
  modified_base (173)..(173): a, c, t, g, unknown or other
  misc_feature (173)..(173): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtcagccgtgggagtccctgagactctctgtcgcagcctctggtacttccacttccaccttcctatgatttccacgtcgggtcccgccagactccaagacgtaaggggcttaggagtggggtggacaggtcatagtctaaagttgattgggagaccctaaattttaaaaagtttacgtacggtaccggtaacctccggttacggaaaccgggttaccgtaacgtttccaaaccctaagttacccttcccgaaaggtaactaaacctaaacgtttcccgaaagggtaaaaccaacctaacctttcggttttacctaacggtaaccgtaaaagttacgaaaccgtacggtacccgttaagtaaacgtaaagttcggaaacgggttaacgttaccggggttaaattaacggttaaaccttaacgttgttaccgaccccgttacggtacccccgttcgtaaccgtacgtaaaccgttaaacccggacgtttaccggttacccgaccccggttacggggaccctaacggggaacccctgggttaccccgtaacccggttcctacccgtaacccg

SEQ ID NO: 173187 - DNA, 808 bp, Homo sapiens
  misc_feature: GYAE6OF02J1HBK.7.76.G10.1.454.CMB.1.raw
  modified_base (369)..(369): a, c, t, g, unknown or other
  misc_feature (369)..(369): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttcgtccacggtcgagcttgctagtagaggaagaaggagccggcggtcggtccagccgtgggacgggtccctggagacctcttcctgtacgcacgcctcgtaggtacttcctaccttcctactttcctattcgtatttccctaccgttcgggtccgccgacgaccttccgaagaccgaaacggggccgtagggtaggtgggttcggacgtacgtcgaatactaaccgatttgaacgngggacgtacctaaatttaaaactttacgttaggtaccggtacgttaccggtacggtaaaccgggtcgttaacttaccgtactacgttacccgtaccgtaacggaacgtaaccgtaacttacccgtaaacgggtaactaaaccctaaacgttcggtttaaccgtcgtaaacttaaaaccggttacgaaacgtaaccggtacccgttaaggaaacgtttaaacgtacggaaacgggttaaccgttaacggggttaacttaacgttacgtaacggtttacggttacccgaccgttaccccggaacccgttacgtaccgtaccggttaaccttaaacccgggtaacgtttccgggttacccgaaccccggttcggggacccgttaaccgggtacccggtacccgggtaaccttacccggttacccgttaccccgtaacccggg

SEQ ID NO: 173188 - DNA, 585 bp, Homo sapiens
  misc_feature: GYAE6OF02IG3HE.7.76.G10.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (391)..(391): a, c, t, g, unknown or other
  misc_feature (391)..(391): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccaggtgagcttgctgtagaggaagaggagccggngtgtccagcctgggagtccngagactctctgtgcgagccctntggattccaccttcacttccatgactttccagtggtccnccagtactccgaagacgaaggggcctaggagtgggtggctagtcaatanctaatgatgganacaattaaatttgngacgtactacggtgaaacggtcgattccgactatccgtacagacacactacaggaacacacttnttcagacaagtgaacacgtctacgagtaattagacggtacgtgggtaactactaacgtacgtcgtccgtacccgtcgtaccccgtagtaccgtacgaacgtaacccgggtacgttacggtacccgtaccggtaccggggtcccggaacgggtaacccggtacggtacccgtacccgttaccgtaccctacccgg

SEQ ID NO: 173189 - DNA, 686 bp, Homo sapiens
  misc_feature: GYAE6OF02JHMAT.7.76.G10.1.454.CMB.1.raw
  modified_base (167)..(167): a, c, t, g, unknown or other
  misc_feature (167)..(167): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagtcttgctgtagaggaagaggngccggcgtgtccagccgtgggacgtcctgagactctcctgtcgcagcctcgtaggtacttccaaccttctacttcctattcgtactttccgacgttcgggtcccaccagtacctaccaggaacgaacggggctcgggaggtcgggtgacctagtccaatactactaagttgagtggtaacgacctaaattaaatttagcgtacgtacttccggtagtaaccggtgtactaccaactactcctaccgaagtacgtaacctaacgtaccgaacggaaccaacgtacgttacgttactacgtaactaaacgtacgaacgtacgtaccgtagtaacgtaacgtagacgggttacgtacgggttaacttaacgtacttacgttacggtaccgtacccgtaccgtaccccgtagtaccgtacgtaaccgtaaccggtaccggtacggttacccggacccggtaccgggtacccgtaccgggtaacccgttccggtacccgtaccggtacccgttacccgtacccg

SEQ ID NO: 173190 - DNA, 624 bp, Homo sapiens
  misc_feature: GYAE6OF02F0QSK.7.76.G10.1.454.CMB.1.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacggttcctgagacctctcctgtgcagcctcgtggacttccaccttcacttcctatgactttccacgtgggtccnccagacctccagacaagggctggagtgggtgcagtcatancaatgatggagcctaaattaaatttngcgactcgtagacgtgatcaactatccnctagacgactaacttccaagaaccactacttgtttcctagaactaaacgtcgaaaccacgacctaggaacgtaagttcggaaggtaccgtcgggttaatactacttagtcgttaccgcccgttaccgtaccccgtagtaccgtacgtaaacgtaaacccggtacggttccgggttaccccggtaaccccggttccggggggaacccgttaaccgggggaccccgttacgggtaccccgtacccgtttaccgttaccccgtacccgg

SEQ ID NO: 173191 - DNA, 577 bp, Homo sapiens
  misc_feature: GYAE6OF02G9CPG.7.76.G10.1.454.CMB.1.raw
  modified_base (336)..(336): a, c, t, g, unknown or other
  misc_feature (336)..(336): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctcgtggacttcgacccttcaccttcctatgtactttccacgtgggtccgccagacctccagaccgaaggggctggagtggggtgcagtcatactacaatgatggagacctaattaaattttngacggactccggtagaacggtcattccaacctatcctacagacgactaacgttccgaaggaaccactactgttctagactaaatacgaacagtcctagagtagttagaggtacgtagggtatatactacgtgtccgtcccgtaccgacccctgtacgtacgtaacgtaaccggtacgttccggttaccgtaccccggtcgggacccgacgggacccgtcggtaccacccggtcctcctccg

SEQ ID NO: 173192 - DNA, 860 bp, Homo sapiens
  misc_feature: GYAE6OF02I2IV9.7.76.G10.1.454.CMB.1.raw
  modified_base (171)..(171): a, c, t, g, unknown or other
  misc_feature (171)..(171): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagcggngtgtccagcctgggacgtccctgagacctctccgtgtcgcacgcctcgtaggacttccaccttccactttcctagtcgtactttccacgttcgggtcccgtaccacgtacctaccgacggaacgaacgggggtcctggggtaaggtcgggggttacgtaccgtacgttaccgtaagttacgtaacctaaagtttacggaaggttacgggtaacggtaaacccttaaaattttaaaaaacggttttttacgaacggggtaccggttaaccgttacccggtttaaggtaaaacgggttcgggttacccgttaacggtttacccgaaaccctacctttacccgtacccgaaaggtaacccggtaaccttaaaacccggtttacccgaaaagggaaaccctaaccggtttaacgttttacgttttaccgtaccggtaaactaaaacttacgggaaacctacgtacccgtaaggtaaacgttaaacggtttaggaacgggttaacccggttaacgggttaatttaaccgttaaccgttaacgttacggttcccgtaacccggttaacccgtaaccccgttagtacccgttaacggtaaccgttaacccgggtacgttccggttacccggtaaccccgggtccgggtaacccgggtaacccgttcggtacccgtaccgttcccgtaccgtacccg

SEQ ID NO: 173193 - DNA, 736 bp, Homo sapiens
  misc_feature: GYAE6OF02ISEMU.7.76.G10.1.454.CMB.1.raw
  modified_base (145)..(145): a, c, t, g, unknown or other
  misc_feature (145)..(145): n is a, c, g, or t
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (382)..(382): a, c, t, g, unknown or other
  misc_feature (382)..(382): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtnagcttgctgtagaggaagaaggcgccggcgtggtccagccgtgggacgtccctgagtacctctcctgtcgcacgtcctntaggtacttcctaccttcaccttcctatcgtaactttccacgtcgggtcccnccgagtaccctccgaacgacggaaggggtctagggtagggtggggttaggccaacggttcaagttactactaagttggagttggactacctaaatttaaattttcncgggtaccgtacgttccggtaggaacggttcgtacttccaacctactttccgaccgaacggaactaactaaccgtttacccgaaaggtaaccctacgttaacctttggtttacctacgtaaactaaactccgaaacacggtaccttaggaaagttaacgttggaacggttacgttaacggttaatacgttaccttagtcggttaccggcccgttacccgtaccccgtagtacccgtagtaaaccggttaacccgggtactttaccgggttaaccccggtccccggtaacgggggtaccccgtaaacgggttaccccggttggtaccccccttacggtcccctcccttaacccgg

SEQ ID NO: 173194 - DNA, 780 bp, Homo sapiens
  misc_feature: GYAE6OF02JU8IN.7.76.G10.1.454.CMB.1.raw
  modified_base (167)..(167): a, c, t, g, unknown or other
  misc_feature (167)..(167): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggcgtggtccagccgtgggagtccctgagactctcctgtgcacgcctcgtggattccaccttctaccttcctatgtactttcctacgtcggggttcccgccaagacctccgtaacggaacgtaaacgggggtccttaggggacggttgggggttcgggaccaacggttaccaagttaacgttacctaaaagtttgggtaagtttaggggaaccggttaacccttaaaagtttttaaaaaaagttttttacgtcgggtaacccggggttaacctttacccgggttaacggggtaaaccgggtttaccggtaacttttacccgaaacccctaacgtttacccgtaccgaaaggtaacggtaacctaacgtttacccgaaacggaaacctaacctacgttacgtttacgtacgaactaaacgtacgaaactacggtaccctaggaaacgtaattaggaacggtacggtacgggttaatacttaacgtacgtcgtaccgtcccgtaccgaccccgtagtacctagtaaccgtaaccggacgttacggtacccggtacccgacggggaccgtaaccgggtacccgtcggtaccctcccgttccgtacccgtaccg

SEQ ID NO: 173195 - DNA, 676 bp, Homo sapiens
  misc_feature: GYAE6OF02IP9YJ.7.76.G10.1.454.CMB.1.raw
tcagcgtgtctctacacgaccggtgctcgatttagtcactcatacagggagagctcttctgtgtgtagtggttgtgcagagcctcatgcatcgacggagcatgagaagaccgttcccctgctgccacctgctcttgtccacggtgagcttgctgtagaggaagaaggacgccggcgtggtccagccgtgggacgtccctgacgacctctcctggtcgcacgtccttcgtggtacttccaccgttcaccttcctatcgtactttccacgttcgggtcccaccagtacctacaggaacgaacggggctgggaggtgggtagcgagtcatactacgtaattgagtggacgacctaaattaaattttagcgtacgtactccggtacggtaacggtcgttaataccactacttacctacgacgtaagtacctaacgtccgaaacgaaacccacttacttcgtttcacgtactaaacgtacgaactacgtctaagtaagtaactgggaagttacgtacgttaatacttacctaggttcctcggtacccgtacccgacccgtacgtaaccgtacggtaaccggttaaccgtcgtttaacccggtacccggttaccccggacggggtaacccgtaaccggggtcccgttaccggtaccccgtaccggttccctacccgtacccg

SEQ ID NO: 173196 - DNA, 716 bp, Homo sapiens
  misc_feature: GYAE6OF02HU5AM.7.76.G10.1.454.CMB.1.raw
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (370)..(370): a, c, t, g, unknown or other
  misc_feature (370)..(370): n is a, c, g, or t
  modified_base (471)..(471): a, c, t, g, unknown or other
  misc_feature (471)..(471): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttcgtccacggtgagtcttgctgtagaggaagaaggngccggngtggtccagccgtgggacgtcccgtgacgactctctgtgcacgctctggtacttccgtacttcctacttctatcgtactttccgagtcgggtccaccacgtactccgaagacggtaaggggctagggtaggtgggtcgcacgtctaacgtatacgtaattggaagtcgggactacctaaattttaaaagtttcgngggtaaccggtaccttcggtacgggtaaaccgggttcaacgtttccgaacctacgttccgtaccaagggaactaacctaacgttacccgaaacggtaaacnccgtaccgtttaggtttacctaacggtaaactaaaggtacaaaccggacgttagtaacggtaaacgttaaggttacggaaccggttaaccggttaaggttaaatccgtttaaccgtaggcgttacccgccccgtacgtacccgtagaccctaggtaaccggtaccgtcggttacccggcccggtaacccggtaccgggaccgttaacggtcccgtagttaccccggacttcccgaccgttaaccg

SEQ ID NO: 173197 - DNA, 604 bp, Homo sapiens
  misc_feature: GYAE6OF02HCLDC.7.76.G10.1.454.CMB.1.raw
  modified_base (268)..(268): a, c, t, g, unknown or other
  misc_feature (268)..(268): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacggtccctgagactcctcctgtgcagcctcgtggattccacctttcacttcctattcgtactttccacgtcgggtccnccagacctccagacgaagggctgggagtgggtgcagtcatatcaattgatggacncctaattaaatttngcggactccgtagaacggtcgtacttcactntcctacagacactactaccaagaacactacgttgttctagactaaatagaacacgacctagtagtaacttaggtacggacgtcggttaactacgttaactcgttagtccgtcccgtaccgtaccccgttagaccctacgtaacgtaacccggtaccgttccgggttacccggaccccggtcgggacccgtaccgggtacccgtacggtacccgtaccggttccctacccgtacccg

SEQ ID NO: 173198 - DNA, 708 bp, Homo sapiens
  misc_feature: GYAE6OF02IZWZL.7.76.G10.1.454.CMB.1.raw
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacgtccctgacgactctcctgtgcagcctctggattcaccttcacttcctatgtatttccacgttcgggtcccncacgacctcacgtacgaaggggctgggagtgggtcgcagtcatntacaattgatgacgactaattaaatttngcgtactcgtgaacggtctatcactagtcctacaagacgactaacgttaccgaaggtaaacctacctaacgtttacggtttctacggtaacctaaaacgtacggtaaaaccaacggtacccgttaacggtaaacgttaacgttaggtaaacgggttaccggttaacggggttaaacttaacgttaaccgttaaccgttacggttccggttaaccccggttaccgttacccccgtagtaaccgttacggtaaaccgttaaacccgggtccggttaccgggttaccccggaaccccggtttacggggaaccccggtaacccgggtacccggttaccggtaaccccgtacccggttaccccttacccgttaacccg

SEQ ID NO: 173199 - DNA, 794 bp, Homo sapiens
  misc_feature: GYAE6OF02IWPIH.7.76.G10.1.454.CMB.1.raw
  modified_base (285)..(285): a, c, t, g, unknown or other
  misc_feature (285)..(285): n is a, c, g, or t
tcagcgtgtctctacacgaccggtgctcgatttagtcactcatacagggagaggctcttctgtgtgtagtggttgtgcagagcctcatgcatcgacggagcatgagaagaccgttcccctgctgcccacctgcttcttgtcccaggtgagtccttgcttgtagaggaagaaggcgccggcgtggtccagccgtggggacgtccctggagcctctccgtgtgcagtccctacgtggtacttcctaccttcaccgttcctatcgtactttccgacgttcgggtcccnccaggtaccctccgacggaccgaaggggtctaggggtggttgggtggtaccagttactagttaactaccgtaaagttgaagttcgggataacccgttaaagtttaaaacgtttttgacccgggtaaccgggtaccgttacccggtaaggtaaccggggttacctaacgtttaccccgaaaccttaccgttcccttaaccccgggtaagtaaaccggttacccgttaaacgttaccccggtaaaaccgggtaaaccgtaacccgtttaccgttacggttttaaccgacgtaaacccgtaaacgtacgtaaaccgtaccggtcccgtaaggtaacgtaacgtttagggaaccggttacggttacgggttaattacgtacttaccgttcgtaccggttccccgtaccgtaccccgtagtaccgtacgtaaccgtaaccggtccgttacggtacccggtacccggtaccggtacgtacccggtaccgtacgtccgtacctcccgtcctaccgg

SEQ ID NO: 173200 - DNA, 854 bp, Homo sapiens
  misc_feature: GYAE6OF02IWUFS.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccaggtgagcttgctgtagaggaagaaggagccggcgtggtccagccgtgggacggtccctgagtacctctcctgtgcagcctctggattccaccttcacttcctatgtactttccacgtgggtccccgacctacgacctaccagaaccgaaggggtctgggaggttggggtggctagtctaatactactaagttagagtaggacgacctaaatttaaaattttacgacgtacggtacctaccggtaggtaaccggttcgtacttaccaaccgtattacctacccgaagaaccgtaaactaaacgtttaacccgaaacggtaaacctaaccgtaaccttacgtttttaccgttagtaaaccgttaaaaacgttaacggaaaaccgtaaccggtaaccccgttaggtaaaacgggttaaagtttaacggggaacgggttaaaccggtttaccggggtttaaactttaaaccgtttaaaccgtttaaccggttaccggttacccgggttacccccggttaacccggttaccccccgttacgtaaccggttaacggttaaacccgttaaaaccccggggttaaccgtttaaccccggggttttaaccccggtaacccccgggttaccggggggtaacccccggttaacccgggggtaacccccggtttacccgggttaccccggtaacccccggtttaccccgtttaccccgtaaccccgg

SEQ ID NO: 173201 - DNA, 570 bp, Homo sapiens
  misc_feature: GYAE6OF02II8WY.7.76.G10.1.454.CMB.1.raw
  modified_base (330)..(330): a, c, t, g, unknown or other
  misc_feature (330)..(330): n is a, c, g, or t
  modified_base (389)..(389): a, c, t, g, unknown or other
  misc_feature (389)..(389): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggagtccctggagactctcctgtgcagcctctggattccaccttcacttcctatgatttccactcgggtccgccagactccagacgaaggggctgggaggtgggtggcagtcatatcaattgatggagacctaataaattttngcgtactccgtgaacggtcgattcaccatcctcagagaactatccaaggaacacacttntttacagacaatgaacacgacctagaagtagtagacgtacgtacgggtaatacgtactacgtgtccgtcccgtcgtaccccgtagacctagacgtaaaccggtcgttacggttacccggaccccggttacgggacccgtacggggtacccgtcggtacccgtaccgtcccgtcctacccgg

SEQ ID NO: 173202 - DNA, 905 bp, Homo sapiens
  misc_feature: GYAE6OF02IY08Y.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccacggtgagcttgctgtagaggaagaggagccggcgtggtccagccgtgggacgtccctgagctctcctgtgcacgtcctcgtggtacttcctaccttctacttcctatcgtactttcccacgttcgggtcccgaccgacgacctaccgaaggaaccggaagggggtcgtggggtaacgggttcggggggtggaccgtacggtacctaattaacgttactaaggtttcggaaggttcgggtaaacgtaacccttaaaaagttttaaaaacgtttttacggtacggtaacccgggttacccgtttaccggggttaacgggtaaaccgggttaccggttaactttaccccgaaaccgtaccttacccgtaacccgaagtaaccgtaaacttaaaccgttacccggaaacggtaaacctaccgtaacgtttcgtttactacgtaacgaaactacgaaacgtacgaccttaggaacgttaagtacgggtaaacggtacggttaacgggttaacttaaaccgttaccgttaaccggttacggttaccccgtaccccggtttaaaccccggtaccccccggttaaggttaacccgttaaccggttaaaaccgggttaaaccccgggttacccggtttaacccggggttaccccccggttaaaccccggggttccgggggtaaaccccccgggttacccggggttaaaaccccggttcccgggtttaacccccggtaaccccccggtttacccgttccccccggtaacccccg

SEQ ID NO: 173203 - DNA, 525 bp, Homo sapiens
  misc_feature: GYAE6OF02HXHIF.7.76.G10.1.454.CMB.1.raw
  modified_base (161)..(161): a, c, t, g, unknown or other
  misc_feature (161)..(161): n is a, c, g, or t
  modified_base (292)..(292): a, c, t, g, unknown or other
  misc_feature (292)..(292): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctctgtccacggtgagcttgctgtagaggaanaaggagccggcgtggtccagcctgggaggtccctgagactctcctgtgcagcctctgtattcaccttcacttccatgatttccactggtccgcagactccagacaagggctggagtgggtggcagtcatancaatgatggagcaataaatttangcgactcgngaacgtgatcacatctcagagacaattccaggaacacgaactgttactgacaaatgaacagccngtanaactgagactcggtatatactatgtcgccgtcgacccctagactcgaataaaccggacgttacggttaccggaaccccgttcggggacccgtacgggaaccccgttacggtacctaccggtcctcccgtaccg

SEQ ID NO: 173204 - DNA, 712 bp, Homo sapiens
  misc_feature: GYAE6OF02JGP14.7.76.G10.1.454.CMB.1.raw
  modified_base (278)..(278): a, c, t, g, unknown or other
  misc_feature (278)..(278): n is a, c, g, or t
  modified_base (455)..(455): a, c, t, g, unknown or other
  misc_feature (455)..(455): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccacggtgagcttgctgtagaggaagaaggcgccggcgtgtccagcccgtaggggacggtccctggagtacctctcctggtgccagccctcgtggactttcaccttcaccttctactgtactttccacgtcgggttcccncacgacctaccgacgacgaacgggtcgtacggaggtggtcgactagtcagtatcaagttggagtcggactacctaaagtttaaaactttagtcggaccgtacgtaccgtacggacgtcgtaacgttcacccgtatccaccgtagactactaactacgacgaacacgtactcgttcanacgtaactcgaactcgaccgtgaacgtactaggtacggtacgttacgggtaactagttaacgtacgttacgtaccgtacccggtaccgtaaccccgtcgtaccggtaaccggtaaccgttaaacccggggtaaccgttacgggtttaacccggtaacccccgggtaccgggtaacccgggtaaccccggggttaaaccccgggttccgggtaaccccgtttaaccccccggttacccgttaccccgttaaccccggg

SEQ ID NO: 173205 - DNA, 594 bp, Homo sapiens
  misc_feature: GYAE6OF02IH7GY.7.76.G10.1.454.CMB.1.raw
  modified_base (399)..(399): a, c, t, g, unknown or other
  misc_feature (399)..(399): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagtcttgctgtagaggaagaaggagccggcgtgtccagccgtgggacgtccctgagactctccgtgtgcagtcctcgtgtacttccaccttcacttctatcgtactttccacgtcgggtccacagacctccagacgaggctggagtgggcacagtcatcactagtgagtggacactaaattaatttgcgacgtactcgagtacgtcgattccactatctacgagtacactactacgaacgaacactattcgttntacgactaaagtacgaactacgacgtagaagtaagtggaacggtacgttacgggtaatacgttactacgttcggtaccgtcccgttaccgtacccctagtacgtacgaacgtaaccggcgttaccggtaccccggtacccgtacgggaccgttaccggacccgtcggtaccgtacccgttacccgtcctacccgg

SEQ ID NO: 173206 - DNA, 642 bp, Homo sapiens
  misc_feature: GYAE6OF02F40HE.7.76.G10.1.454.CMB.1.raw
  modified_base (219)..(219): a, c, t, g, unknown or other
  misc_feature (219)..(219): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccaggcctgggacggtccctgagactctcctgtgcagcctntggattcaccttcacttcctatgactttccacgtgggtccgcagacctcagaccgaggggctgggagtgggtggcagtcatatcaattgatgganacctaataaaattttnagaccgtactccgtaggaacggtcgattacgaccatccgtcacgagactacgttaccgaagaacacacttgttacngaacaaagtcgaacgagtacccgtagaacgtaagttcggaaggtaccgttcgggtaattaattaacccgttacgttacggttccgtaccccggttaccgtacccccgttaggtacctacgtaaccggtaaaccccgggtgttaccgggtaaccccggtaacccggttccggggacccgttaaccggggtcccttaccgggtacccgtacccgggttaccctacccggtaaccccgg

SEQ ID NO: 173207 - DNA, 696 bp, Homo sapiens
  misc_feature: GYAE6OF02HRIQR.7.76.G10.1.454.CMB.1.raw
  modified_base (197)..(197): a, c, t, g, unknown or other
  misc_feature (197)..(197): n is a, c, g, or t
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
tcagcgtgtctctacacgaccggtgctcgatttagtcactcatacagggagaggctcttctgtgtgtagtggttgtgcagagcctcatgcatcacggagcatgagaagacgttccccctgctgccacctgctcttgtccacggtgagcttgctgtagaggaagaaggagccggcgtggtccagccgtgggagtcccngagacttctcctgtgcagcctctggattccaccttcacttcctatgatttccacgtcggtccncagcctccagacgaagggctggagtgggtggcagtcagtatacgaattgagtggacgacctaattaaattttanggtaccgaactccggacgtaacggtcgtacttcacctacttcctaccgagacgaactactacccgaacggaacacgtacttgttactaacggtctaaactacggaaaccgacgtaccgttagaaaggttacgtaggtacgggtaaccgtttacgggttaattaacgttaacccttacggtttacggtccccgtccccggttaaccgtaccccccggtagtaaccccgttaggaaaacccgttaaacccccgggtcggttaaccggtttaacccccgggtaccccggtaccggggtaccccggtaacccggggaaccccggtttaccggtacccgtaccccggttcccttacccgtaccccgg

SEQ ID NO: 173208 - DNA, 739 bp, Homo sapiens
  misc_feature: GYAE6OF02IRKU9.7.76.G10.1.454.CMB.1.raw
  modified_base (272)..(272): a, c, t, g, unknown or other
  misc_feature (272)..(272): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggagccggcgtggtccagcccgtggggacgtccctggacgacctctccttgtgccagccttctggtacttccaccttcaccttcctatgtactttccacgtgggtcccncagcctccagacgaaggggctggaggtggggtgcagtcatacactaattgatggactacctaattaaattttgacgacgtactccggtaggtaaccggtcgtacttaccaacctatccctaccgaagacgtaacctaacgttacccgaaacggtaacctaacctaccgtttacgttttacctacggtaactaaacgtacgtaaaccgtaccggtaccgttaacggtaacgttaaagttacggaacgggttaccgttaccgggttaatttaacgtaaccgtttacgttacgttacccggtaccccggttaccggtaacccccgtagtaacccgttacggtaacccgttaaacccgggtacggtttacccgggttaccccggtaaccccgggttccgggggaacccgttaacccggggtaccccggttaccggtaccccgtacccggttacccgttcccgtaaccccgg

SEQ ID NO: 173209 - DNA, 621 bp, Homo sapiens
  misc_feature: GYAE6OF02GOHX2.7.76.G10.1.454.CMB.1.raw
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagactctcctgtgcagcctctggacttccaccttcacttcctatgatttccactgggtccnccagactccagacaaggggctggaggtgggtggcagtcatatcaattgatgganacctaattaaaattttngacggtactccgtagaacggtcgattcaccatctccagacgactaattccaaggaaccactacgttgtttacctacgactaaatcgaaaccacggacctaggaagtaagttcggaacggtaccgttacggggtaattaacgttacgttacgttcggtaccgtccccgtacgaccccccttggacccttagaaccgttaacccgggtcttacgggttaccccgaccccggttacggggaccccgtaacggggtaccccgttacggtccctacccgggttccctacccgtacccg

SEQ ID NO: 173210 - DNA, 757 bp, Homo sapiens
  misc_feature: GYAE6OF02GUA5C.7.76.G10.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggngtggtcccagcctgggagtccctgagactctcctgtgcagcctctggattcaccttcactttcctatgtatttcccacgttcggggtccctccaggaccctccaagaaccgaagggggcctgggaggttggggtgccgtagtcaatactctaaattgaagttcgggagtaccctaaattaaaatttttgcggaccgggtaaccttcccggtagggtaaacccgggttccgtaacgtttcccaaacccgtattcccgttacccgaagggtaacgtaaaccttaaacgtttacccgaaagggaaacctaacctaacgtttcgttttactacggtaacctaaagtaccgaaactaacggcccttaggaagtaaacttagggaacgggtaaccgttcggggttaattacgttaaccttaaccggtcggttaccgtaccccgtacccgacccccttaggtaacccgttacgtaaaccgtaacccgggtaccgttaaccgggttaccccgtaacccgggttaccggggtacccgtaacccggggtaacccgttccgggtacccgtaacccggttcccgtacccgtacccg

SEQ ID NO: 173211 - DNA, 764 bp, Homo sapiens
  misc_feature: GYAE6OF02IQGK9.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttccctgctgccactgctcttgtccacggtgagcttgctagtagaggaagaaggcgccggcgtggtccagtcccgtgggacgttccctggacgtaccttctccgtggtacgcctacggtcccttcgtaggtactttccaccgtttccaccgttcctagttacgtaccttttcccgacggttccgggtacccacgtacgacctccgaaggaccgaaggggtcctgggacggttgggtcgaccgtagttacaagttacgtacgtaagttcgacgttacgggaactaccgttaaaatttaaacgttttcggacggaccggttacccgttaccgggtaacgtaaccggttcgtaacttacccaaccttacgtaccgtacgtaacgaacgtacctaacgttaccgaaacggtaacctaccgttacgtttacgtttacgacgtaataaaccgtacgtaaccgtacgtacgtagtaacgtaacggttacggaccggttaacgtacggttaacttacgtaaccgttacgtcgtcccgtacccgtaccgtaccccgtagtaccttacggtaacgtacccggtcgttacccggtacccgacccgggtacggacccggtaaccggttacccgtaccggtccgtacccgttccctaccgtaccg

SEQ ID NO: 173212 - DNA, 766 bp, Homo sapiens
  misc_feature: GYAE6OF02HJ2H7.7.76.G10.1.454.CMB.1.raw
  modified_base (268)..(268): a, c, t, g, unknown or other
  misc_feature (268)..(268): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacgtccctgagactctcctgtgcacgcctctggtattctacccttcacctttcctatcgtatttccacgtcgggtcccnccaacgtacctccagaacgaagggcgtagggaggtcggggtcgacgtaggtcctaagttactacgtaacttaggaagttcgggaaacgtaacccttaaaagttttaaaaacgttttagtacggtaccgggtaacccttacccggggtacgtaaaccggttacggtaacttacccgaacctacgtccctacccgaaggtaacgtaaactaacctttacccggaacggtaaacctaaccgtaccgtttcgtttactaggtaacctaaacgttcgaaaccgtcgtaccgttaagagtaaacgttcggaacggtacgttaacgggttaatacgtttaacgtaccgttcgtcccggtacccgtacccgtaacccgttacggtaagtaccgtaaaccggttaacccgggtaccgttacccgggttccggtaaaccccggtccgggaaccggtacccgggtaacccggtcggtacccgtaacccgggttccttacccgtacccgg

SEQ ID NO: 173213 - DNA, 813 bp, Homo sapiens
  misc_feature: GYAE6OF02I8PEY.7.76.G10.1.454.CMB.1.raw
  modified_base (174)..(174): a, c, t, g, unknown or other
  misc_feature (174)..(174): n is a, c, g, or t
  modified_base (196)..(196): a, c, t, g, unknown or other
  misc_feature (196)..(196): n is a, c, g, or t
  modified_base (805)..(805): a, c, t, g, unknown or other
  misc_feature (805)..(805): n is a, c, g, or t
tcagcgtgtctctacacgaccggtgctcgatttagtcactcatacagggagaggctcttctgtgtgtagtggttgtgcagagcctcatgcatcacggagcatgagaagaccttcccctgctgccacctgctcttgtccacggtgagtcttgctgtagaggaagaaggagccggngtgtccagccgtgggacgtccngacgactcgtcctgtgacacgtcctcgtggtacttcctaccctttctaccttcctattacgtacttttccacggttccgggtacccgaccgtacgacccttaccgaacggaacggaacggggtcgtagggtagggtcgggttaggccgtaggtctaatctaagtagttacggagttcggaacgtactaaaactttaaaagttttacgcggtaaccgggtaccttaccgggttaacgggtaaccgttaccgttaacctttacccgaaccgttaccgttacccgttaaccggtaagggtaaacccgtaacgttaaacccgtttacccggtaaaaccgggtaaacctacccggttaacttttccggtttaacgaaccgttaaaccgtaaaacgttacggaaaccgtaccggtaaccgttagggtaaaacgttaaggtttacgggaaaccggttaaccggttaacggggttaattaaccgttaccgttaacggttcgtacccggaccccgtacccgttcctacgtacgttacggtaccgtaacccggttcgtaaccggtacccggtacccgggtcggaaccggtaaccggccttaccggacccttaccggtcncccgtacg

SEQ ID NO: 173214 - DNA, 900 bp, Homo sapiens
  misc_feature: GYAE6OF02G5TX8.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggacggtccctgagactctcctgtgcagcctcgtggacttcaccttcacttcctatcgtactttccgacgttcggggttccccaccgacgtaccttacccaaggtaaccggaaacgggggtccttaggggaggttcgggggtacgggtacgacggttcaagttaacttaccgtaaagtttggaagttcgggaacgtaccctaaagtttaaaaatttttacgtacgggtaccgggtaaccttccggttaaggtaaacccgggtttccggaacttttacccgaaacccgtacttacccgttaccgaagggtaaccgtaacctaaaccgtttacccgaaacgggtaaacccaaccgttaacgtttacggttttaccttacggtaaaccgtaaaacgtacgtaaaccggtaccggtaccccgttaagggtaaacgttaaacgtttacgggaaaccggggttaaccggtttaaccgggtttaaatttaacgttaaacccgttaaccggttttaccggttaccccggttacccccggttacccgggtaaccccccgttacggttaaccggttaccgtaaaccggttaaaccccggggttacccgttaccggggtttacccccgggtaacccccggttccgggggtaaccccgtaacccgggggttaaccccgttaccgggtaccccgttaaccccggtttccctacccggttaccccgg

SEQ ID NO: 173215 - DNA, 733 bp, Homo sapiens
  misc_feature: GYAE6OF02JCMBT.7.76.G10.1.454.CMB.1.raw
  modified_base (270)..(270): a, c, t, g, unknown or other
  misc_feature (270)..(270): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgagaggaagaaggcgccggcgtggtccagccgtggggacgtcccgtagagcctctcctgtcgcacgcctcgtggtacttccaccttcaccttcctagtgtacttccacgtcggtccnccacgcctaccagaacgaaggggtctagggacggtgggtcggcgtacggtactatagtactaagttgagtcggaactacctaaatttaaacgttagtacggaccgtaccgtacgtacgggtacgtacgtacgttaccgacctacgtacgaccgtaagaacgtaacgtaaccgttaccgaaacggtaaacccaaccgttaccgtttacggtttactaaccgtaacgtaaacgtaacgtaaacgtaccgttacgttaacgtaaaggttaacgttaggaaccggttacggtaacggttaaacgttacgttaaccgttacgttcggtacgttccccggtaccgttacccgtacgtacgtacgaaccggttaaccggtaccggttaccgtacccggtaacccgggtcggtaacccggtaacccgggtaccgtaccggttacccgtacccgttaccgtcccgtaacccg

SEQ ID NO: 173216 - DNA, 709 bp, Homo sapiens
  misc_feature: GYAE6OF02JAJ91.7.76.G10.1.454.CMB.1.raw
  modified_base (274)..(274): a, c, t, g, unknown or other
  misc_feature (274)..(274): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggacgccggtcgtggtccagccgtgggacggtccctgacgactctcctgtcgcacgtcctctggtacttcctacccttctaccttcctatgtactttccacgtcggtccnccacgacctcgagacgaagggtccgtggaggtgggtggcgtaggtcatagtactaagttgacgtggacgaccttaaattaaaaacgttttgtacggaccggtaacttccggtacggtaaccggttacgtacttaccgacctactccgtaccgagtaacgtaactaacgttacccgtaaacggaactacccttacgttcgtttaccacgtaacgaaagtaccgaacctacgtaccctaggaaggtaactagggaaccgggtacgtacgggttaacttaagtaccgttacgtacggtccgtaccccgtacccgtaccccgtcgtaccgttacgtaaccgtaacccggtaccgttaccgggttccccggtaacccggtccgggaacccggtacccgggtaacccgttcggttacccgacccggttccctacccgtccg

SEQ ID NO: 173217 - DNA, 591 bp, Homo sapiens
  misc_feature: GYAE6OF02GIIVO.7.76.G10.1.454.CMB.1.raw
  modified_base (144)..(144): a, c, t, g, unknown or other
  misc_feature (144)..(144): n is a, c, g, or t
  modified_base (209)..(209): a, c, t, g, unknown or other
  misc_feature (209)..(209): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtnagcttgctgtagaggaagaaggagccggcgtggtccagccgtgggagtccctgagactctcctgngcagcctctgattccaccttcacttcctatgatttccactggtcccgccagactccagacgaaggggctggagtgggtggcagtcagtatcaattgattggagaccaattaaaactttatagcggtactccgtacggaacggtcgtattccaccatctaccagagacaacttaccaggaaccactactgtttactgacaaatacgaacacgcctagaagtaattagaggaccgttagggtaattacttaacttacgttagtcgtacccgtccgacccctgtacctcggtaactaacccgggtacgtaccggttacccgaccccggttcggggacccacggggtaccccgttacggaccgtaacccgtccgtcccgtacccgg

SEQ ID NO: 173218 - DNA, 804 bp, Homo sapiens
  misc_feature: GYAE6OF02FUOH3.7.76.G10.1.454.CMB.1.raw
  modified_base (168)..(168): a, c, t, g, unknown or other
  misc_feature (168)..(168): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggngccggcgtggtccagccgtgggagtccctgagactctcctgtgcacgcctctggacttccaccttcacctttcctatcgtactttccacgttcgggtcccgccgacgtacctccgaagaccgaaagggggtcctaggggtaggttggggtcggccgtaggtccaagttacgtcgtaaatttggaagtgggaacgtaccctaaatttaaaaacgtttttgacgggtaccggtaaccgttaccggtaggtaaaccgggttcgtacgtttacccgaacctacttaccctaccgaacggtaacgtaacctaaacgtttacccgaaacggtaacctaccgtacgtttacggttttacctacggtaaacctaaagttaacggtaaaccgtacggtacccgttaaggaaacggttaaaacgtttaccggggtaacggttaaccgggtttaaccgggtaaatttaccggttaaacctttacgttacggttaccgtaccccggtaccggtaaccccccttaggtacccgttacggtaaaccgttaacccgggttcgttaccgggttaccccggtacccggttaccgggacccgtaacccgggtacccgttccggtacccgtacccggttcgtaccccgttaccgg

SEQ ID NO: 173219 - DNA, 662 bp, Homo sapiens
  misc_feature: GYAE6OF02GV6A0.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtgggaggtccctgagactctcctgtgcagcctctggacttcaccttcacttcctatgtactttccacgtgggtccgcctagacctccgagacgaagggctggaggtgggtgcagtcatactcaattgatcggagacctaaattaaaattttagacgcggtacttccggtaggtaaccggttcgtaacttcaacctactacctaccgagtaacgactaacgttaccgaacggtaaacaacgtacttcgtttacgtagtaactaaactacgaaaccgacgtacctaggtaacgtaaagttacggtaacggacgttaccgggttaattacgttaaccttacgttaccggtccggtacccgtaccgtaacccccgtagtaccgtacggaacgtaacccggtacggttaccggttaccggtaccccggtacggggacccggaccggtacccgtacggtacccgtaccgttcctaccctcccg

SEQ ID NO: 173220 - DNA, 713 bp, Homo sapiens
  misc_feature: GYAE6OF02FXX5F.7.76.G10.1.454.CMB.1.raw
  modified_base (144)..(144): a, c, t, g, unknown or other
  misc_feature (144)..(144): n is a, c, g, or t
  modified_base (267)..(267): a, c, t, g, unknown or other
  misc_feature (267)..(267): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtnagcttgctgtagaggaagaaggagccggcgtggtccagcctgggagtccctgagacctctaccgtgtcgcacgtcctctggactttccaccgttcacttcctatgactttccacttcggtccncctagactccagacgaagggctggagtgggtggcagtacagttatctaaattcgagtcggactaccgtaaattaaacgtttagtcgcccggtaactcccggtaaggtaaccggttaccgtaagttacccgaacctaacttccgtacccgaaggtaacaacctaactttacccggaagtaaacctaccgtacgttacgttacgtacgtaactaaacgtacgaaacgtacgtacgttacggaacgtaattacggaacggtacgttacgggtaacttacgtaaccctaacggttccgttaccgacccggtaccgttaccccgtacgtaccgtacggtaaaccgttaaccgggtaaccggttaccgggttacccggtaccccggttaccggggaccgtaacccgggtacccgttacgggtacccaacccggtttcccgacccttacccgg

SEQ ID NO: 173221 - DNA, 686 bp, Homo sapiens
  misc_feature: GYAE6OF02F3LWZ.7.76.G10.1.454.CMB.1.raw
  modified_base (145)..(145): a, c, t, g, unknown or other
  misc_feature (145)..(145): n is a, c, g, or t
  modified_base (168)..(168): a, c, t, g, unknown or other
  misc_feature (168)..(168): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
tcagcgtgtctctacacgaccggtgctcgatttagtcactcatacaggggagaggctcttctgtgtgtagtggttgtgcagagcctcatgcatcacggagcatgagaagacgttcccctgctgccacctgctcttgtccacggtnagcttgctgtagaggaagaaggngccggcgtggtccagcctgggacgtccctgacgactctccgtgtcgcacgcctntggtattccaccctttcactttcctagtcgtactttccgacgtcggggtcccnccaagtaccttccgaaggaccgaagggggtccttagggagggttcggggtcgaccgtagtccaagttacgtctaaagtttcgaggttacgggaactaccttaaatttaaaacgttttgacgggtacggtaccgttccggtaggaaccggttacgtaactttaccgacccgtacttacccgtacgaacggtaactacgtaacttaccgaaggtaacctacgtacgtttcgtttacacgtaacgaatacgtaacgacgtacctaggaacgtaatagggtacgacgtacggtactactacgtacgtgtccgtacccgtcacccgtagtacgtacgtaacgtaccggtcttacgggtacccgacccgttcgggacccgtacgggtaccctcggtacccgtaccgttccgctaccg

SEQ ID NO: 173222 - DNA, 722 bp, Homo sapiens
  misc_feature: GYAE6OF02F4R46.7.76.G10.1.454.CMB.1.raw
  modified_base (278)..(278): a, c, t, g, unknown or other
  misc_feature (278)..(278): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggacgtccggcgtggtccagcccgtgggacggtccctgagtacctcgtcctgtcgccagcctctggtacttccacctttcacctttccgtatgtactttccaacgtgggtcccncacgacctccgaagaccggaaggggctgggaggtggtggcgtagtccagtagtactaattcgagtggaacncctaaattaaaatttntacggcgtactccggtagacggtcgtaatcgacctactccgtacgagaactactaacgtaccgaagaacctacctacgttagttcgtaacgtaactaaagtacgaaccgtagtccgtagaaacgttacgttacgaacgggttaacgtcgggttaaacttacgtaaaccgttactcggtacccgtaacccgttccccggaacccccgttagggaacccttagggtaaaccgtaaaccccggggttaacttaccccggggtttccccggaacccgggtacccggggttacccccggaacggggtaaccccggttaccgggtaacccccgtaccccgggtttacctaccccggtaacccg

SEQ ID NO: 173223 - DNA, 760 bp, Homo sapiens
  misc_feature: GYAE6OF02F6B8J.7.76.G10.1.454.CMB.1.raw
  modified_base (145)..(145): a, c, t, g, unknown or other
  misc_feature (145)..(145): n is a, c, g, or t
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (221)..(221): a, c, t, g, unknown or other
  misc_feature (221)..(221): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtnagcttgctgtagaggaagaaggngccggngtggtccagccgtgggacgtccctgagactctctgtcgcacgcctgngtacttccaccttcacttctatgtacttccacgtggtccgcagacctccagaacggagggctgggacggtgggtgctagtcatatacaagttcgatgggacacctaaatttaaaatttgcgacggtacctcggtaggtaaccgtcgtacttccaaccgtatcccgtacagaacgtaacctaacgttacccgaagggtaaccacgttacgttacgttttccaaggtaacctaaacggtacgaaaccgtaacggtcccgttaaaggtaaacgtaacgttaagggtaaccgggaaccggtttaacgggtaaactttaacgtaaccgttaaccggttaggttacccccgtacccccgttaacccggtaacccccgttaggttaaccgaccggttaaaaccggtaacccggggtttacgttaccccggggttaacccccgggtaaccccggggttccggggaaccccggtttaaacccggggtaacccccggtttaccgggttaccccgtaaccccggtttcccgttaaccccgtaaccccggg

SEQ ID NO: 173224 - DNA, 693 bp, Homo sapiens
  misc_feature: GYAE6OF02I6Y1O.7.76.G10.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (179)..(180): a, c, t, g, unknown or other
  misc_feature (179)..(180): n is a, c, g, or t
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagcgtgtctctacacgaccggtgctcgatttagtcactcatacagggagaggctcttctgtgtgtagtggttgtgcagagcctcatgcatcgacggagcatgagaagacgttcccctgctgcccacctgcttcttgccacggtgagtcttgctgtagaggaagaggngcgngtgtcnncgtgggcgtcctgagctctctgtgcncgtcctgtgtactacctacctctacttcctatgttcttccncgtcggtcccgccgtacgaccgtccaacgacggtacgggcgtggggtaggtcgggtggactaggtctaattaactaccgttaagttaggaggtacggtaacgtaaccttaaagtttaaaatttttacggacggtaccgggtacccgttaccggtacgggtaaccggttaccgttactaccctaactcttaccacccgtaagaactaacgtaccgttaaccgaacgtaaaccctacgtaccgtttcgttacgttacaactaaacgtacgtaaccactccgtagtagtacgttagggacgtacgttacggtaattaacgttactcgttcgtacccggtccctacccggtcccgtgtaccgtacgaacgttaaccggtcgtttacccggccggtaccccggtgggaccgaccgggtaccgttccggtccttaccgtcccgttcctcccg

SEQ ID NO: 173225 - DNA, 839 bp, Homo sapiens
  misc_feature: GYAE6OF02H431O.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaggacgccggtcgtggtccaggccgtggggacggtccctggactaccgttctccctggtcggccagcccttacgtggtacttccctaccctttactacctttacctatcgttacttttacccgtacgtcggggttaccccgccaagtacccgtaccgaggaccggaaacggggggttccgtaagggggtacggggttcggggggttcgggtaccgtaacggttccgtaatttacgtaccgttaaaagttttggaacggtttcgggaaacgttacccttaaaagttttaaaaacgttttttacgacggtaccggttaaccgtacccggtaggtaaccgggtacgtacttaccgtaacctactaccgtaaccgtagaacgtaactaacgttaacccgaacggtaaacctaaccctagtttaccgtttctacgtaaactaacgtaacaaccgtacgtaccttaaggaagttaacgttaggaacggttacggtacggttaacgtacttaccgttaacgtccggttacgtcccgttaaccgaccccttggtaacctacggtaaaccggttaacccggttacgggttacccggttcccgggtaaccccggttacggggaaccccggttaaccgggtacccggttaccggtaccccgttcccgttacccgtcccgttaacccgg

SEQ ID NO: 173226 - DNA, 870 bp, Homo sapiens
  misc_feature: GYAE6OF02GBEZ8.7.76.G10.1.454.CMB.1.raw
tcagcgtgtctctacacgaccggtgctcgatttagtcactcatacaggggagaggctcttctgtgtgtagtggttgtgcagagcctcatgcatcacggagcatgagaagacgttccccctgctgcccacctgctcttgtcccacggtgagcttgctgtagaggaagaaggagccggcgtggtccagcctggggacgtccctgacgactctcctgtgcacgcctctggacttccaccttcaccttcctatcgtacttttccacgttcgggtccccgccacgtacctccgaagtaccgaagggggtctaggggtagggtcgggggttcgacgtagttccaagttaacttaccgtaaagttttcggaagtttcggggaacgtacccgttaaaattttaaaaaacgtttttcgtaccgggtacccgggtttaacccgtttccccggggttaacgggttaaaccccgggttccggttaaaccttttaccccgtaaaccccttaacgttaccccgttaacccggaacggtaaacggtaaaccctttaaaccgtttaccccggaaagggtaaacccctacggttaacccgttttcggttttaaccgtacggtaacctaaaacgttaccggaaaccgttacgtacccgttagtaacggtaagtttcggaacggttaccgttacggggtaacttacgttaaccgtacgttacggtaccggtccccttaccggtacccctaggtacccgttacgtaacccgttaaaccgggttccgtttaccgggttaccccggtaaccccgggttaccggggtaaccccgtaccgggtaaccccggttccggtaccccgttaccccggttcccttcccgttaaccccgg

SEQ ID NO: 173227 - DNA, 669 bp, Homo sapiens
  misc_feature: GYAE6OF02HFN50.7.76.G10.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (270)..(270): a, c, t, g, unknown or other
  misc_feature (270)..(270): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggngccggngtggtccagcctgggacgtccctgagacctctcctgtcgcacgcctcgtggtacttccaccttctaccttcctatgtactttccacgtcgggtcccnccagacctccagacgaagggctggagtgggtcgcagtcatatctaattgagtggacgacctaaattaaattttgcggtaccggtacttccggtaggtaaccggtcgtaacttccaacctactcctaccgagtacgaactaacttccgaaggtaaacctacgtacgtttacgtttcacgtaactaaagttcaaaccgtacgtaccgtaagaacgtaagttacgggaacggtacgttacgggttaattacgttaccgttacgttcgtccgtaccccgttaccgaacccccgttagaaccgtacgtaaccgtaaccgggtcgttaccgggttacccggaccccggtaccggggaccctaaccgggtaccctccggtaccctacccggttcctcccgtacccg

SEQ ID NO: 173228 - DNA, 710 bp, Homo sapiens
  misc_feature: GYAE6OF02GYU9Y.7.76.G10.1.454.CMB.1.raw
  modified_base (497)..(497): a, c, t, g, unknown or other
  misc_feature (497)..(497): n is a, c, g, or t
tcagcgtgtctctacacgaccggtgctcgatttagtcactcatacagggagaggctcttctgtgtgtagtggttgtgcagagcctcatgcatcacggagcatgagaagacgttccctgctgccacctgctcttgtccacggtgagcttgctgtagaggaagaaggacgccggcgtcggtccagccgtggggaggtcccctggacgtaccttctcctggtacgcacgccctcgtaggtacttccgaccttcaccttcctatcgtactttccacggtcggtcccgtccacgtacctaccaggaaccgaaaggggtcgtagggtaggtcggggtgacgtagtactatacgtacgtaagtgtagtacggactacctaaagttaaattttagacggtacggtactccggtacgtaacggtactagttaccactactcctacgacgaacgtactaacgtaccgtaacgaaataccgtattcggttacacgtaactaaacgtanaaacccgagtaaccgtagtaagtaaagttacggaaacggtccgttacgggttaaatacgtaaccgttaacgtcggtaccgtcccggtacctaaccccgtataaccgttaccgtaaacggtaacccggtaccgttacggttccccggacccggtacgggtacccggaaccgggtacccgttacggtaccccaccggttaccctacccgtacccg

SEQ ID NO: 173229 - DNA, 699 bp, Homo sapiens
  misc_feature: GYAE6OF02F7BF5.7.76.G10.1.454.CMB.1.raw
  modified_base (144)..(144): a, c, t, g, unknown or other
  misc_feature (144)..(144): n is a, c, g, or t
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
  modified_base (333)..(333): a, c, t, g, unknown or other
  misc_feature (333)..(333): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtnagcttgctgtaggaggaagaaggngccggcgtggtccagcctggggacgtccctgagctctcctgtgcagcctntggacttcaccttcacttcctatgtacttccacgtggtccgcacgactccagacgagggctagggagtgggtgacagtcatatctaattggataggatacctaatttaaatttanaggtccggacttccggtaggtaacggtcgtacttccaacctacttcctccgaaggtactaactaacttaccgaacggaaaccacctaacgtttaccgtttactacggtacctaaacgtacgaaacctacgtacctaggaaacgtagttacggtaacggtaaccggttacgggtaaactttagtaacccgttaacgttacggttccggtacccgttaccccggttaacccctaccggtaccgttacggtaaaccgttaaacccggtaccgggtttacggtttaccccggaacccgggttccggggtaacccggtacggggtaaccccgttcgggtacccgttaaccccgtacccgtcccgtaacccg

SEQ ID NO: 173230 - DNA, 686 bp, Homo sapiens
  misc_feature: GYAE6OF02JP265.7.76.G10.1.454.CMB.1.raw
  modified_base (168)..(168): a, c, t, g, unknown or other
  misc_feature (168)..(168): n is a, c, g, or t
  modified_base (379)..(379): a, c, t, g, unknown or other
  misc_feature (379)..(379): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccaggtgacgcttgctggtagaggaagaaggngccggtgtggtccagccgtgggacggtccctggacgtctcctcctggtgcacgcctcgtggattcctacttctacttctatgtactttcccacgttcgggcccacgtagacctccaacggacgaacgggggtctcgggaggtgggtcgacgtagtacaagtactacgtaagttaggagcgggtaacctaccgtaaaatttaaaacggtttncggtaaccggtaccgttaccggtaggtaacccggtcgtactaccaacctntcctaccganaacgtacctagtaacccgagaacctactacggtttcttacgacacgtaacgtacaagtccgtacgtacgagtacgttagacggtaccgttacgggtaacttacgtacgtaccgtcgtcccgtacccgtaccgtccccgtagacccggttacaacggtacccggtacggtaccggttacccggtacccgggcggtaaccggtacccgggaccgtttccgacccggttcccgttacccgacctacccgg

SEQ ID NO: 173231 - DNA, 840 bp, Homo sapiens
  misc_feature: GYAE6OF02HMN35.7.76.G10.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (294)..(294): a, c, t, g, unknown or other
  misc_feature (294)..(294): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgcttcttgtccacgggtgagcttgctagtaggaggaagaaggngccggngtggtccagccgtggggacgttccctggacgtacctctcctgtacgctacgtccctgtggtactttccacctttacacctttccttatcgtacttttacccgacggttccgggcccnccgtacgtacctacccgtaagggaaccgtaaggggggtcctacggggtagggttggggtacggtaccgtacggtactaagttacttacgttaagtttacggaaggtacggaactaaccttaaaagttttaaaacgttttcgacgggtaccggtaccttaccggtaacgggtaaccggttacgtaacgttaccaacccgttacttcctaaccggtagtacgaacctaaagttacccgaaagggtaaacccaccttacgtttacgtttaccacggtaactaaacgtcgaaaccggtcgttacgtaagtaagggttactttacgggaacggtaacggtttaacgggttaaagtttaccgtaacgtttaccggtggtttaccccgacccgggttacccgtaacccggttagtaacccggtacgttaaacccggttaacccggtaaccggtttccgggggtaaacccctaccccggggggttaacgggcccggtaaccgggttaacccggtcgggttaaccccgtacccggtttacctccccggtaaccgg

SEQ ID NO: 173232 - DNA, 584 bp, Homo sapiens
  misc_feature: GYAE6OF02JDYB4.7.76.G10.1.454.CMB.1.raw
  modified_base (270)..(270): a, c, t, g, unknown or other
  misc_feature (270)..(270): n is a, c, g, or t
  modified_base (346)..(346): a, c, t, g, unknown or other
  misc_feature (346)..(346): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
tcagcgtgtctctacacgaccggtgctcgatttagtcactcatacagggagaggctcttctgtgtgtagtggttgtgcagagcctcatgcatcacggagcatgagaagaccgttcccctgctgccacctgctcttgtccacggtgagcttgctgtagaggaagaaggagccgggcgtgggtccaggcctggggacggtccctggagactctcctgtgcagcctgtggattccaccttcacttcctatgtactttccacgttcgggtcccnccagtacctccagacgaaggggctggaggtgggtgcagtcaatatcaattgagtcggagacctaattaaatttacngacgtactccgtaggtacggtgacttcacntctcagacactactcgagaacactacttgttcngacaatacgacagacctagagtagttgaggtaccgnggttattactactacgtgtccgtcccgtcgtaccctagtaccgtacgaacgtaacccggtcgttaccggttaccgtaccccggtacgggtaccgtacccgggtacccgtaccggacgttccccgttacgtcccgtaccg

SEQ ID NO: 173233 - DNA, 897 bp, Homo sapiens
  misc_feature: GYAE6OF02HAWKZ.7.76.G10.1.454.CMB.1.raw
  modified_base (145)..(145): a, c, t, g, unknown or other
  misc_feature (145)..(145): n is a, c, g, or t
tcagcgtgtctctacacgaccggtgctcgatttagtcactcatacagggagacggctcttctgtgtgtagtggttgtgcagacgcctcatgcatcacggagcatgagaagacgttcccctgctgccacctgctcttgccacggtnagtcttgctgtagaggaagaaggagccggcgtggtccagccgtgggacgtccctagagactctccgtgtgcacgccttcgtaggtacttcctaaccttctaccgttttcctagttcggtacttttaccccacggttccggggttccccaccgtaacggtacccttccgaaacggaaccggtaaggggggtccttagggggaaccggggttgggggttacggacccgtaaggttacctaagtttaacttaccgtaaagttttggaacggttacggggtaaccgttaaccctttaaaaagtttttaaaaacgttttttaacggcccggggtacccggtttaacccggtttaccccggggtttaaacgggtaaaccccggggtttttaccggtaaaccttttacccgaacccgtttaaaccctttacccgtttaacccggaaagggttaaaccgttaaccccggttaaaccgtttaacccgggaaaacgggtaaacctaaccgtttaaccggttttcgtttaccgtaacggtaactaaacgtacgaacgacgtacgtaggtaacgttaacgtcggaagggttcgttaacgggtaactttacgtaaccgttacggttacgtcccggttaccccgtacccggtacccctaggtacttacggaaccgttaacccgggtcgttaccggttacccggaacccggtcgggtaacccgtaccgggtacccgtcgttaccccgaccgtttcccgacgtacccg

SEQ ID NO: 173234 - DNA, 728 bp, Homo sapiens
  misc_feature: GYAE6OF02GL79I.7.76.G10.1.454.CMB.1.raw
  modified_base (271)..(271): a, c, t, g, unknown or other
  misc_feature (271)..(271): n is a, c, g, or t
  modified_base (355)..(355): a, c, t, g, unknown or other
  misc_feature (355)..(355): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagccgtggggacggtccctagagactctcctgtgcagcctgtaggtacttcctaccttcaccttcctatgtactttccacgtcgggtcccncagacctccgagacggaagggctgggaggtggggtcgactagtcagtactactaattcgatcgggacactaaattaaatttcgnggtacgtactccggtagaacggtcgtaactaccgactactcctacgaacgtacgaactaacgttacccgaaggtaaaccacgtacgtttacggtttctaacggtaactaaacgtacggaaaccgacgtacccgtaaggtaaacgtaagttaggaacggttaccgggtaacggttaacttaacgtaaccgttcgtacggtaccgttccccgtacccgtaacccccgtaggtaaccttacggtaaacccggtaaacccggttccggttaccggttaccccggaacccccgggttgggggaacccccgtaaccgggggttaaccccgttaccggtaacccccggtaacccgtttccccggttacccgtaccccggg

SEQ ID NO: 173235 - DNA, 669 bp, Homo sapiens
  misc_feature: GYAE6OF02HQWRO.7.76.G10.1.454.CMB.1.raw
  modified_base (169)..(169): a, c, t, g, unknown or other
  misc_feature (169)..(169): n is a, c, g, or t
  modified_base (176)..(176): a, c, t, g, unknown or other
  misc_feature (176)..(176): n is a, c, g, or t
  modified_base (284)..(284): a, c, t, g, unknown or other
  misc_feature (284)..(284): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgcccacctgcttctgtccacggtgagcttgctgtagagggaagaaggngcccggngtcggtccagcctgggacggtccctggagacctctcctggtagccacggccttcgtcgggtatttccgacctttccacctttcctatgtactttccacgtcgggtccnccagtcctccagacgaagggctggaggtcggtgcaggtcattatactaattcgagtcggagtaccctaatttaaaattttcgacggtccggtacttaccggtaggtaaaccgggttcgtaactttccaaccgtacttccaccgagacgtaactaactcccgaaggtaaccaccgtacttcgtttacgtacgtacaaacgtcgaacgtacgaccgtagaacgtagtaggacggtacgtacggttacgttaacttacctacgtcgtccgtcccggtccaccccgtgtaaccgttcgaaccgttaacccggtcgttccggttacccgtaccccgggtaccgggacccgtacggacccgttcggacccttaccgtccttcccgtacccg

SEQ ID NO: 173236 - DNA, 798 bp, Homo sapiens
  misc_feature: GYAE6OF02JII4U.7.76.G10.1.454.CMB.1.raw
  modified_base (169)..(169): a, c, t, g, unknown or other
  misc_feature (169)..(169): n is a, c, g, or t
  modified_base (225)..(225): a, c, t, g, unknown or other
  misc_feature (225)..(225): n is a, c, g, or t
tcagcgtgtctctacacgaccggtgctcgatttagtcactcatacagggagaggctcttctgtgtgtagtggttgtgcagacgcctcatgcatcacggagcatgagaagacgttcccctgctgcccacctgctcttgtccacggtgagcttgctgtagaggaagaaggngccggtcgtggtccagccgtgggacggtccctggagactctcctgtcgcagtcctntggacttccaccttcacttcctatcgtactttccacgtcggtccgccacgcctaccgacgacgaacgggcgtgggtaggtgggtcggcgtacgtctacgtactactaacgttagtagtaggtaccgtactaagtttaaattagtacgtaccggtacgtacggtacggtacgtacgtacgttaccaacgttttttacgacgtaccgtaagaacgtaacctaaacgtttaccggaaaccgtaaaccgttaacccgtaccgtttacgtttaccgtacgttaaaccgtaaacgtaacgaacccgtaaccgttaccgttaaacggtaaagttaaacggttaacgggtaaccgggttaaccgggttaacgggttaacttaaacccgttaaaccgttaccggttacggtaccccggttacccgtaccccgttaaccccgtacgttaacccgtacggtaaacccggtaaccggttaccgggttacccggttacccgggtaaccccggtacccgggtaacccggtaacccgggtaaccccggttaccgtacccggtacccgttaccccgtaccgtaaccccg

SEQ ID NO: 173237 - DNA, 810 bp, Homo sapiens
  misc_feature: GYAE6OF02GQW4M.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagaccgttcccctgctgcccacctgctcttgtccgacggtgagctgctgtagagaagaggagccggcgtgtccagccgtgggacggtccctgacgtacctcctcctggtgccacgcctcgtaggtacttccaccctttcctacctttcctactcgtactttcccaccgttcggggtccccgccgacgaccctaccgaaggaaccggaacggggtccgttaggggtacgggtgggggtcggccgtaggttacaagttacttacgtaagtttaggagtagggtaacgaaccctaaagtttaaaaagttttacgtacggtaccggtaccgttaccgggttacggtaaccggttaccgtacttacctaaccctaacgtccctaccgaacgtaacgtaaccgtaaccgttaacccgaaggtaaaccccaaccgttaacgtttcggttttaccgtaccgtaaccaaacgtaacgaaaccgtacggtacccttaggaacgttaagtacggtacggtacggttacggtaaacgttaacttaccgttaacgttcggtaccgtaccccggtaccggtacccccgtagtacccgttaggtaacccgtaaccgggttacccgtaccgggtttacccggaaccccggttccgggacccggtaaccggggtacccgttaccggttaccccgtaccggttccccgtcccgtaaccccgg

SEQ ID NO: 173238 - DNA, 731 bp, Homo sapiens
  misc_feature: GYAE6OF02I97BC.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagacgttccctgctgccacctgcttcttgtaccacgggtgagtcttgcttggtaggaggaaggaaggacggccggtcggttcggtccaggccgtggggacggtccctaggacgtacctctccgtgtgccacgtcctcgtggtacttcctacccttcaccttcctatgtacctttccacgttcgggtcccgacctacgtacctaccgacggaacggaaggggtcgtgggtagggttggggtcgggtcgtacggtactaatacgtactaagttagagtaggtaccgtacttaaatttaaagtttcgtacggtaccggtaccgtaccggttacgggtaaccggttcgtacttacccgaacctactacccgttacgaacgtaacgaacctaacgttacccgaaacggtaaaccctacgttacttcggtttacgacgaaactaacgtacgaacgtacggtacctaagtaacgtaagtacggaaggttacgtacgggtaatactaacgttacgtccgtaaccgccggttaccacccgtagactacgggtaacctaccgggtaccgtacggttcccgaccgggtaccgggaccggtaccggttaccgtccggtccgtaccttccgcccgtac

SEQ ID NO: 173239 - DNA, 767 bp, Homo sapiens
  misc_feature: GYAE6OF02G9439.7.76.G10.1.454.CMB.1.raw
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggagtccctgagacctctcctgtgcagcctctggattccaccctttnacctttcctatgtactttcccacgttcgggtccnccagacctccgaagacgaaggggtctagggaggtgggtggcgtacggtacattactcaaagtttcgatggacgtaccaagttaaaaattttgtacgaccggtactaccggtacggtaaacgggttctatttccgaaacctacgtacctacccggtaggaacgtaaaccttaaacgttacccgaaacgggtaaaccaaccgttaaccgtttacggttttaccgtaacggtaaccttaaaagtaaccgtaaaccgtaaccggtcttaacggtaacggtaagtttacgggaacggttaaccggtacggggtttaaactaacgttaaccgtttaacgttccggttacgtacccccggttaccgtaacccccgttacgaaccgttacggtaaaccgttaaaccccgggtacggtttcccggttaaccggtaccccggtacggggtacccggtaaccgggtacccggttaccggtacccgttcccggttacccgtccgttaacccg

SEQ ID NO: 173240 - DNA, 743 bp, Homo sapiens
  misc_feature: GYAE6OF02FLX5Q.7.76.G10.1.454.CMB.1.raw
  modified_base (231)..(231): a, c, t, g, unknown or other
  misc_feature (231)..(231): n is a, c, g, or t
  modified_base (513)..(513): a, c, t, g, unknown or other
  misc_feature (513)..(513): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgcccacctgctcttgtccacggtgagcgttgctagtagagggaagaaggacggccggcgtcggtccaggccgtggggacggtccctggacgacctcctccgtgtgaccgngcccgtacgtggtacttcctaccttctaccttcttatcgtactttacctacgtcgggtcccaccgacgtacctaccgtacggacggtaacgggtcgtagggtacgggtggggtcggtcgaggtctaagtactacgtaagtgtacgtagggactacgtaaattaaatttgtcggacgtacgtaccggtagtacggtactactccacgtactcgtacaacgtacgactacgttaccgaacggtaactaccgtacgtttgttacgtaacgtaccaaatcgtaacncgtacctaggtagtaacggttacgacgggtacgttaaccgggtaattacgttaaccgtacgtacgtaccgttaccccggtcccgtaaccgtacgtaccggtaacggtaacgtaaacccggggttcgttaaccgggtcccccggtaacggggtaccccgggtaaccgggaaccggttacccccgggttaggtaaccccggtttaccccgttaccggtcccctaacccgggg

SEQ ID NO: 173241 - DNA, 580 bp, Homo sapiens
  misc_feature: GYAE6OF02FQG9S.7.76.G10.1.454.CMB.1.raw
  modified_base (328)..(328): a, c, t, g, unknown or other
  misc_feature (328)..(328): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggacggtccctgagacctctcctgtgcagtcctctggacttcacctttcacttcctatgacttttccactgggtcccgccagcctccagacgaagggctggagtggtggcagtcatatcaattgatgagccaattaaatttngcgactccgtagaacgtgtacttcaccgatcctcgagacgaactattaccgaggaacactacttgttctagacaatgaacagtcctagagaagtagacggtacgttacgggtatacgtacgtacgtgtccgaccgttaccgtaccccgtgaccctaggaacctaaacccggtcgttacggttacccggaacccgttcgggacccgtacggtaaccccggttacggtaccctacccggttcctccgtaacccg

SEQ ID NO: 173242 - DNA, 807 bp, Homo sapiens
  misc_feature: GYAE6OF02HVPUZ.7.76.G10.1.454.CMB.1.raw
tcagcgtgtctctacacgaccggtgctcgatttagtcactcatacagggagaggctcttctgtgtgtagtggttgtgcagagcctcatgcatcacggagcatgagaagtaccgttcccctgctgcccacctgcttcttgtccacggtgagtcttcgctgtagacggaaagaaggcgccggcgtggtccacgccgtgggacgtccctgacgtactctccgtgtcgccacgccttgtgtacttccgtaccttcctactttctattagtactttacccacgttcgggtcccacgacgtcctaccgagacggaacggggtcgtgggaggttggggtcggacgtaggtactaagtactataacgttagagtcggaacgtaaccttaattaaaacgtttttgcggtaccgtaccgttaccggtacggtaacggttcgtaacgttaccctaactcttacccgtaccgtaagaccgtaacctaacctttacccgaaacgaaacccgttacttaccgttttacgttaccgtaacgaacgtttaaaccgaacgaaccttacggtaccgttagtaaacggtttaacgtacgggtaaaccgttccgggttaggtttaaaccttaccgtttaacgtttcgtacccgggttccccggttaaccccgttacccggtaccccgttagtaccggttaacccgtaaacgggttaaaccccggttgtttaccccgggttaaccccgtcccggggtacgggaaccccgttaccgggttaaccccggtccgtaaccccggtttcccgtacccgttcccgttaacccgg

SEQ ID NO: 173243 - DNA, 1082 bp, Homo sapiens
  misc_feature: GYAE6OF02G86S5.7.76.G10.1.454.CMB.1.raw
tcagcgtgtctctacacgaccggtgctcgatttagtcactcatacagggagaggctcttctgtgtgtagtggttgtgcagagcctcatgcatcaacggagcatgagaagacgttccctgctgccacctgctcttgtccacggtgagcttgctgtagaggaagaaggagccggcgtggtccagccgtgggacggtccctaggagtacctctcctgtgccacgccgtgtaggtacttccgtaccttcaccgttcctattcgtatttccaccgttcgggtcccgacctaaggtaccctaccgaacgaccggaaaggggtccgttacgggggaggtgggggttcggtacggtacggttccaagttacgttacgtaaagtttcgggtaagttcggggaacgttaaccttaaaacgtttttaaaaaagttttttacggttaccggggtaccgggtttaacccggtttccccggggttaaaacggggtttaaccccgggggtttaaccggttaaccggttttaacccccgaaaccccttaaacggttacccccgttaaaccccggaacgggttaaaacccggttaaaccgttaaaacccgttttaacccccggaaaaacgggtaaaccccgtaaacccgttttaaccgttttacccgggtttttacccgaaaggtttaaacccgttaaaaacgtaaccgttaaaaaccgggttaccggtaaccggttaaagggtaaaccgggtttaaaggtttacggggaaaccgggttaaaccgggttaccggggttttaaaagtaacccgtttaaacccgtttaacggtttaaccgggtttaccccggtaacccccggtttaccccggtaaccccccgtttaagggtaaacccggttacgggtaaaaccccgttaaaaccccgggggtttcccggtttacccgggggtttaaaccccccggtaaccccccgggggttttaccccgggggggtaacccccggttaaaaccccgggggttacccccgggtttaaaccccggggtttaacccccggtaaaccccccggttttccccggtaacccccggtttaaccccggg

SEQ ID NO: 173244 - DNA, 753 bp, Homo sapiens
  misc_feature: GYAE6OF02JH0AS.7.76.G10.1.454.CMB.1.raw
  modified_base (132)..(132): a, c, t, g, unknown or other
  misc_feature (132)..(132): n is a, c, g, or t
  modified_base (307)..(307): a, c, t, g, unknown or other
  misc_feature (307)..(307): n is a, c, g, or t
  modified_base (525)..(525): a, c, t, g, unknown or other
  misc_feature (525)..(525): n is a, c, g, or t
tcagcgtgtctctacacgaccggtgctcgatttagtcactcatacagggagaggctcttctgtgtgtagtggttgtgcagagcctcatgcatcacggagcatgagaacgtaccgttcccctgctgccacctncttcttcgtaccgacgggtcgagtcttgctggtaaggaaggaaggaaggcggccggtcggtcggtaccaggccggtggggacgtcctagacgtacctcctccgtgtcgcgacgtcctgtacggtacttcctaccttcgtaccttcctagtctacctttccgacgtcgggtacccncacgtaccctacgaggaccggacgggtcgtaggggtaggtggggtcgactaggtacattacgtatacgttgaggtacggactaacttaaatttaaatttcgacggacgttaccgtaccggtaggtacccggtctacttaccgacctacttcccgaggtaacgaactactacgttaacgaacggtaactaaccgtctttaacgtcgtactaacgtaaanaccggtaatccgtacttaaggtaacgtaagttaaccgggtacgggtacgttaaggttacttacggttacgttacggtaccgggtaccgtaccccgttaccgaaccccgtagggtaaccgttacggtaaacgtacccgggttacggtcccggttaacccgggccggtaaccggggtaccgtacccggttaccggtaccggtacccgtcccggttccgtacccggtaccg

SEQ ID NO: 173245 - DNA, 760 bp, Homo sapiens
  misc_feature: GYAE6OF02GQ7BB.7.76.G10.1.454.CMB.1.raw
  modified_base (274)..(274): a, c, t, g, unknown or other
  misc_feature (274)..(274): n is a, c, g, or t
tcagcgtgtctctacacgaccggtgctcgatttagtcactcatacgagggagaggctcttctgtgtgtagtggttgtgcagagtcctcgatgcatcgacggagcactgagaacgtccgttcccctgcctgcctacctgctcttgtccacggtgaatcgttgccgtagtacgaggaagaacggtcgccggtacgtcggtccagtccgtaggggacgttacccagacgtacctctaccgtgtagctaacgtccgtcgtacggaattccacccttanacctttcctattgtaaccttcacgttcggaccgaccaaggactaccgaacggaacgtaacggtctaggaggttgaacgccgtaagtcaagttactacgtaaagttcgaagtcgacgtaccgtaaaatttaaaagtttcgaggtacccgtaacgttccggtaagtaccggtacacgttaccaaacgtacgttaccacggtaacgaagaacccgtaacgtacgaacggttaaccaacgtttaccgttagttactaacgtaaacgtaaactacgaaacccgtacgtaccgtaagtacgtaaacgttacggtacgggtaaccttacgggaaacttacgtaaaccgtccgtacgtaccgtacccggtacccgtaaccgtacgtacgtacggtaaacctaacccggtaaggttacccggtacccggtaacccggttccggaaccgttaaccggacccgtacgggttaccaaccccggtttcaaccgttcccg

SEQ ID NO: 173246 - DNA, 827 bp, Homo sapiens
  misc_feature: GYAE6OF02HWKXB.7.76.G10.1.454.CMB.1.raw
  modified_base (174)..(174): a, c, t, g, unknown or other
  misc_feature (174)..(174): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgcttcttgtccacggtgagcttgctgtagaggaagaaggcgccggngtggtcagccgtagggaggtccctgacgactctccgtgtacgcacgccttcgtaggtacttccacctttcaccttcctattcgtactttcccacggtcgggtcccgcctacggacctccgaaggaccggtaaacgggggcgtagggtaggttgggggtaggaccgaggttacaattactacgtaagtttcggaacgttacgggaactaccttaaaatttaaaagtttttacgtcgggtaaccggtaccgttaccggttaacggtaaccgggttaccgtaactttaccccgaacctacgttacccgtaccgtaacgtaaccgtaaaccttaacgttacccgaaacggtaacctaaccgttaccgtttcgttttacgaacgtaactaaacgttacgaaacctacggttaccgaaacggtaaagttaaggttagggaacggttaacggttacggttaaacttaccgttaaccgttaccggtacgttcccggtaccccgttacccggtaccccgttagtaaccgttaccggtaaccgttaaacccggggtcgtttaccccgggttacccgggaaccccgggttaccggggaacccggttaacccgggtacccggttacccggtacccggtacccgtttccccgacccgttaccccgg

SEQ ID NO: 173247 - DNA, 687 bp, Homo sapiens
  misc_feature: GYAE6OF02I6AU1.7.76.G10.1.454.CMB.1.raw
  modified_base (180)..(180): a, c, t, g, unknown or other
  misc_feature (180)..(180): n is a, c, g, or t
  modified_base (500)..(500): a, c, t, g, unknown or other
  misc_feature (500)..(500): n is a, c, g, or t
  modified_base (528)..(528): a, c, t, g, unknown or other
  misc_feature (528)..(528): n is a, c, g, or t
tcagcgtgtctctacacgaccggtgctcgatttagtcactcatacagggagaggctcttctgtgtgtagtggttgtgcagagcctcatgcatcacggagcatgaagaacgtaccgttcccctgctcgccacctgccttcttgtccgacggtgagtcttgctgtagaggaagaggcgccgngtgccagtccgtgggacgtcctagacgtccttccgtcgtgtcgacgtcgtcccttcgtggtactttccctaacccgtttcctacctttcctagttcgttaacttttcccgacggttccgggtcccacctacgacccgtaccgaagaaccggagggggtcctgggggacggttcggggtcgacgtacggttcaagttactagtaacgttgacggtacggaactcttaaaattttaaacgttgtcggaccgtacgtccgtaggtacgtcgtactaccatctcacgagactaactactacgacgtaactacgtattcgtctanaacctagactaatccgtatagagttagngtaacggttcgtagtaattaccgtactacgttacggccgttacccgtaccgtcccgtagttacccgaacgttaacggtaaccgttcggttaccggtcccggtacccggcggttaaccccggacgttcccgtaccgtccgtacctcccgtcctaacccgg

SEQ ID NO: 173248 - DNA, 721 bp, Homo sapiens
  misc_feature: GYAE6OF02HURIQ.7.76.G10.1.454.CMB.1.raw
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtcccacggtgagcttgctgtagaggaagaaggagccggcgtggtccaggcctggggacggtccctagagtacctcctcctgtgccagccttcgtggacttcacctttcacttcctatgtatttccacgtcgggtcccnccagacctccagaccgaaggggcttggaggtgggtggcaggtcaatatcaattgagtggagcctaattaaaattttancgtacggtaccttccggtagtaaacggtcgaatttccaaccctatcctacccgaagacgaactaactttcccaacggaacactacttcgtttcgtacgactaaagtgaaacccgtagtaccctagggaacgtaaacttagggtaacggtaccgtttaacggggtttaaataccgtttaaaccgtttaccgttacgttaccggttccccggttaccgtaaccccccggttagaacccgttacgtaaaccgttaaacccggggtcccgtttaccgggttccccgggtaacccccgggttacgggggacccggtaaccggggacccccggttacgggttaccccgtaaccccggttccgttaccccgtacccg

SEQ ID NO: 173249 - DNA, 707 bp, Homo sapiens
  misc_feature: GYAE6OF02G9SN9.7.76.G10.1.454.CMB.1.raw
  modified_base (173)..(173): a, c, t, g, unknown or other
  misc_feature (173)..(173): n is a, c, g, or t
  modified_base (308)..(308): a, c, t, g, unknown or other
  misc_feature (308)..(308): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggngtggtccagccgtgggacgtccctgagtactctcctgtgtcgacgcctcgtggtacttcctacccttctaccttcctatgtactttccgacgttcgggtcccgccacgtacctccaggacgaacggggcgtgggnggtggggtggcgtagtctatactactaattgagtggacgtacctaaatttaaaagttttagtcgggaccggtaccgttaccggtaggtaacggttacgtaacgttccaacctactccgtaccgaagaacgtaaccgtacgttaccgaaacggaaccaacttacgtttcgtttactacgaactaaacgtacggaactaccgtaccgttaaggtaacgtaagttacgggaacggtaacggttagggttaacttaacgttacgttacgttcggttccgtcccgtacccgaccccgtgtaaccgtacgtaacgtaccggttacggttacccggtaccggtacccggtcgggtacccgtaaccgggtaccgttccggtccgtacccggttacctccctacccgg

SEQ ID NO: 173250 - DNA, 721 bp, Homo sapiens
  misc_feature: GYAE6OF02JDDS7.7.76.G10.1.454.CMB.1.raw
  modified_base (99)..(99): a, c, t, g, unknown or other
  misc_feature (99)..(99): n is a, c, g, or t
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (636)..(636): a, c, t, g, unknown or other
  misc_feature (636)..(636): n is a, c, g, or t
tcagcgtgtctctacacgaccggtgctcgatttagtcactcatacagggagaggctcttctgtgtgtagtggttgtgcagagcctcatgcatcacggancatgagaagtaccgttcccctgctgccacctgcttcttgtcccaggtgacgnttgctgtagaggaagaaggngccggngtggtccngccgtgggacgtccctgacgtcctctcctagtgcacgtcctagtggtacttccaccttacaccgtttcctattcgtaaccttttccaccggttcggggtacccctccgaacgtacccgtccgaacggaacggaacgggggtctaggggtaggtcggggttcggacctaggttacaagttacttacgtaaagtttcgagtacggtaacgaccgttaaattttaaaacgtttagtcgaccgggttacctaccgggtagaaccgggttactacctacctaaccgtacttccaaccgagaaccgtaactaaccgttacccgaaacgtaacctaacgtaccttacgtttccaagtaacctaaactaggtaaccacgtcctagaacgttagttacggacggtaccgttaggtaacttaacgtacgtagtacgtcccgtaccgtaccggtacccgtanaccggtagtaaccgtaacggtccgtaccggtccgacccggtcggaccgtaccggaccgtcgtaccgtcccgtacctccgtacccg

SEQ ID NO: 173251 - DNA, 973 bp, Homo sapiens
  misc_feature: GYAE6OF02GSXOO.7.76.G10.1.454.CMB.1.raw
  modified_base (169)..(169): a, c, t, g, unknown or other
  misc_feature (169)..(169): n is a, c, g, or t
tcagcgtgtctctacacgaccggtgctcgatttagtcactcatacagggagaggctcttctgtgtgtagtggttgtgcagagcctcatgcatcacggagcatgagaagacgttcccctgctgccacctgcttcttgtccacggtgagtcttgctgtagaggaagaaggngccggcgtggtccagccgtggggacgtccctaggagtacctctccgtgtgcacgtcctcgtaggtacttccaccttcctactttcctaagtcgtactttcccgaccgttcgggtccccgaccacgtaccctaccgaggaacggtaacgggggtcgttaggggacgggttggggacggccgtaggttacctaattacgtaacttaaaggttttcggaaacgttacggggtaacctaacctttaaaaagttttttaaaaaacgtttttacgaccgggggtaacccggttaaccgtttcccggggtaacgttaaaccgggggttaccgttaactttaccccaaccttacgttacccgtaccgaaacggtaccggtaaaaccttaaccgtttaacccgaaacgggaaaccccttacgttaacgttttccggttttacaacgtaactaaaccgtaacgaaccgtacggtacccgttaaggaaacgttaacgttacgggtaaccgggttaccggttaaaccgggttaagtttaacctttaacccggttcgggttacccggtaccccggtttaacccccgggtaccccgttaaaccccccgtttagggtaacccgtttacgggtaaaaccggggttttaaacccccgggtccgggtttttaacccgggggttaaaccccccggtaaccccgggggttccccgggggggttaacccccggtaaacccggggggtttaaccccccggtttaacccggggtttccccgtaaccccccggggtttttaccccttaacccggttaaccccccgggg

SEQ ID NO: 173252 - DNA, 486 bp, Homo sapiens
  misc_feature: GYAE6OF01DTDZC.48.79.H02.1.454.CMB.1.raw
  modified_base (463)..(463): a, c, t, g, unknown or other
  misc_feature (463)..(463): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctggtgcgacaggcccctggacaagggcttgagtggatgggaggatcgatccctatctttggtatagcaaactacgcacagaagttccagggcagagtcacgattaccgcggacaaatccacgagcacagcctacatggagctgagcagcctgagatctgaggacacggccgtgtattacgtgtgcgngagatcagagtgttatgtctcgg

SEQ ID NO: 173253 - DNA, 494 bp, Homo sapiens
  misc_feature: GYAE6OF01BUWQ6.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacgggcctgtacttacgtgtgcgagagatcagagttggttattgtcgttccgg

SEQ ID NO: 173254 - DNA, 492 bp, Homo sapiens
  misc_feature: GYAE6OF01CNK1J.48.79.H02.1.454.CMB.1.raw
  modified_base (419)..(419): a, c, t, g, unknown or other
  misc_feature (419)..(419): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatccctatctttggtatagcaaactacgcacagaagttccagggcagagtcacgattaccgcggacaaatccaacgagcacacgcctaacatgganctgagcagcctgagatctgagacacggccgtgtatacgtgtgcgagagatcagagtgttacttagtcgtacgg

SEQ ID NO: 173255 - DNA, 509 bp, Homo sapiens
  misc_feature: GYAE6OF01CRWAW.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaggcttgagtggatgggaggatcatcctatctttggtatagacaaactacgcacagaacgttccgaggcagagtcacgattaccgcgacaaatccacgagcacagcctacatggagctgagcagcctagagtatcgtaggacggaccgacgggtccgtagtagttacgtgtgcgaggagatcgagtagttggtttaattgtcgttaccggg

SEQ ID NO: 173256 - DNA, 536 bp, Homo sapiens
  misc_feature: GYAE6OF01BVV8I.48.79.H02.1.454.CMB.1.raw
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagagcctgggtcctcggtgaaggtctcctgcaaggcttctggaggcaccttcagcagctatgctatcagctgggtgcgacacggccctggacaagggcttggagtggatgggaggatcgatccctatcgttggtatagacaaactacgcaacgagtaacgttccgagggcaggagtcacgattaccgcggaacaaatccgaacgagccaacagaccctanagtgganctagagcagccgtagacgtatcgtagacggaccgaacgggccgttagtacttacgtggtgccggaagacgatacgaggtaggttggttaacttcgtcgttaccggg

SEQ ID NO: 173257 - DNA, 522 bp, Homo sapiens
  misc_feature: GYAE6OF01BBB5O.48.79.H02.1.454.CMB.1.raw
  modified_base (424)..(424): a, c, t, g, unknown or other
  misc_feature (424)..(424): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcgatccctatctttggtatagcaaactacgcacagaacgttccagggcagagtcacgattaaccgcggacaaatccaacgacgcaacagcctacactggaancgtagagacaggcctagagatcgtgaggacagggtccgtgtaacgttacgtgtgacggtagagtatacgagtaggttaggttattagtcgttaacggg

SEQ ID NO: 173258 - DNA, 518 bp, Homo sapiens
  misc_feature: GYAE6OF01BSOLR.48.79.H02.1.454.CMB.1.raw
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttcgtggaggcaccttcagcagctatgctatcagctgggtgcgacgacggcccctggacaagggcttgagtggagtgggaggatcatcctattcgttggtatagcaaactcgacacagtaagtccgaggcagagtcacgataccgacgacaactccacgagcacagcctanagtggagctgagcagcctagganatcnggacggcgaccgggtccgtagtaacttcgtgtagacggagacgtatcgaaggtagttaggttacttacgtcgttaccggg

SEQ ID NO: 173259 - DNA, 554 bp, Homo sapiens
  misc_feature: GYAE6OF01EFHW6.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttggagtggagtgggaggatcatccctatctttggtatagacaaactacgcacagagttccagggcagagtcacgattaccgcgaacaaatccaacgagaccacacgcctacagtggacgctaggacgcacgcctgagatcgtggaacggaccgacgggccgttaggttaacttaccgtggttaggaccggtaaggaacggtacgtacgtaaggtaaggttagggtttaatttacgttcgttacccgggg

SEQ ID NO: 173260 - DNA, 515 bp, Homo sapiens
  misc_feature: GYAE6OF01DDQ9G.48.79.H02.1.454.CMB.1.raw
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatcctatctttgtatagcaaactacgcacagaagtccgagggcagagtacacgtattaccgcggaacaaactccaacgagcacagcctanatgganctgagcacgcctagagactcgtagaggacgaccggtccgtagttattacgtggtgacgagacgatcgagtagttaggtttacttgtccgttacggg

SEQ ID NO: 173261 - DNA, 646 bp, Homo sapiens
  misc_feature: GYAE6OF01C8SVQ.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttctggaggcaccttcagcagctatgctatcagcgtgggtgcgacgacggccccgtggacgaagggcgttggaggtggagtgggagggatcactcctattcgtttaggtatagacaaactacgacaacgagtaacgttccgaagggacaggtacgtaccgaacgtaacgttaacccggacggaaaccaaacgttacccgaacggaacgaccgaaccgaccgacccttaacgacgtaggacgacgtgaacgacgacgaccgtagaagtacgtacgtacggtaacggaccggaaccgggtaccggttacgttaacgttaacggtcggttacggacggtaaggacggtaacttaccggtaaggttaaggtttagggttttaacgttacgtttcccggtttaacccgggg

SEQ ID NO: 173262 - DNA, 656 bp, Homo sapiens
  misc_feature: GYAE6OF01EO1F5.48.79.H02.1.454.CMB.1.raw
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtgggtcctcggtgaaggtctcctgcaaggtcttcgtggaggccaccttcagcagctatgctatcagcgtgggtgcgacgacggccccgtaggacgaagggcttaggaggtggagtggggaggtatcactccctattcgtttaggtatacgactaaactcgacaacgagtaacgttccgaggcagacgtacacgtacttaccgacgaacaactccgaacganaccacgacgacctacagtggacncgtagacgcgacgaccgtaggaacgtacgttacgtagggaaccgggtaccgtaaccggggtacccgtttaggttaaaccgttttaccggtacgggttacgggaaccgggtaaaggtaacggtaacgttacccgggtaaagggtttaacgggtttaagggtttttaacgtttaaccggtttcccgggttttaaacccggggg

SEQ ID NO: 173263 - DNA, 515 bp, Homo sapiens
  misc_feature: GYAE6OF01EXPZV.48.79.H02.1.454.CMB.1.raw
  modified_base (419)..(419): a, c, t, g, unknown or other
  misc_feature (419)..(419): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttggagtggagtgggaggatcgatcctatctttggtatagcaaactacgcacagaagttccagggcagagtcacgtataccgcgaacaaatccacgagcacacgcctacatgganctgagcagcctgagatcgtagacggacacgggccgtagtacttacgtggtagcggagagagtcgaggtacgttaggtttacttagtcgttaccggg

SEQ ID NO: 173264 - DNA, 630 bp, Homo sapiens
  misc_feature: GYAE6OF01DM4BA.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagccgtgggtcctcggtgaaggtctcctgcaggcttcgtggaggcaccttcagcagctatgctatcagcgtgggtcgcgacgacggcccgtaggacgagggcttggaggtggagtgggaggactctactcctagttcgtttaggtatagactaaacgtcgacaacgagtaacgttaccggaggacgtaagacgttaccgaaccggtacgttaacccgggacggtaaacctaaaacgtcccggaaacggacgacctaaccgaccgtacccgttaacgagtacgggacgtcgtaggacgcctacggaccctaggaacgtacgttcgtaggacggaccgtaccggtcgttagttacttacggtggtacggacggtagacggtatacggtaggttaggttagtttacttcgtccggtttaccggg

SEQ ID NO: 173265 - DNA, 500 bp, Homo sapiens
  misc_feature: GYAE6OF01BLQR1.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatcctatcttggtatagcaaactacgcacagaagttccaggcagagtcacgattaccgcggacaaatccacgagcacagcctacatggagctgacgcagcctgagatcgtgacgacgacggccgtagtattacgtgtgacgagagatacgagtagtaggttattagtcgttaccggg

SEQ ID NO: 173266 - DNA, 502 bp, Homo sapiens
  misc_feature: GYAE6OF01CV0LH.48.79.H02.1.454.CMB.1.raw
  modified_base (413)..(413): a, c, t, g, unknown or other
  misc_feature (413)..(413): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatccctatctttggtatagcaaactacgcacagaagttccaggacagagtacacgattaccgcggaacaaatccaacgagcacagcctanatggagctgagcagcctagagatcgtagaggacgaccggccgtagtattacgtggtgcgagagatcgagtagtgttattgtcgtaccgg

SEQ ID NO: 173267 - DNA, 604 bp, Homo sapiens
  misc_feature: GYAE6OF01AGDOJ.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaggtctcctgcaggcttcgtggaggcaccttcagcagctatgctatcagcgtgggtcgcgacgacggccccgtggacgaagggtcttggacggtggagtaggggaggtagtcgacttccgtattcgtttaggtatagactaaactacgcaacgagtaacgttccgaggcagagtcgacgtacttaccggacgtaaccaaagtccgaacggacgaccaaccgacgtaccctaacgagttacggacgtcgtacggacgcgacggtcccgtagtacgtacttcggtacggacggtaccgtaccggtccgttagttacttaccgtggtacgacggaagaggtacttacggaagttacggttagttacttacgtcggttaccggg

SEQ ID NO: 173268 - DNA, 590 bp, Homo sapiens
  misc_feature: GYAE6OF01C9RNJ.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagcgtgggtgcgacacggccccgtggacgaagggcttgaggtggagtgggaggatcatcctattcgtttggtaatagacaaacgtacgacaacgagtaacgttccgaagggacaagacgtacgaacgtaacgttaccgacggaacaaactccgaacgacgcaacgacgacctaacagtaggacgctaggaacgccgtagcccgttagaagtcgtacgtagacgggacgaccggtcgtagttaacttacgtggtcgacggaggaagtaacgtacggtaaggtaggttagggtttaatttagtcccggtttaaccggg

SEQ ID NO: 173269 - DNA, 558 bp, Homo sapiens
  misc_feature: GYAE6OF01CLI9P.48.79.H02.1.454.CMB.1.raw
  modified_base (434)..(434): a, c, t, g, unknown or other
  misc_feature (434)..(434): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagctgggtgcgacacggcccctggacaagggcttgagtggagtgggaggatcatccctattcttaggtatagacaaactcgcacagaagttcgaggcagagtacacgtataccgacggaacaaatccgaacgagccaacacgtacctaacagtcgggaancctaggacgaccgacggccctaggaacgtatccgtaggacggaaccaccgggtcgtagttacgttacgtggtaggacgaaggagacgtctaacggtagttaggtttaattgtccgtttacgggg

SEQ ID NO: 173270 - DNA, 516 bp, Homo sapiens
  misc_feature: GYAE6OF01CE0CN.48.79.H02.1.454.CMB.1.raw
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctggggtcctcggtgaaggtctcctgcaaggcttctggaggcaccttcagccagctatgctatcagctgggtgcgacacggcccctggacaagggcttggagtggatgggaggatcatccctatctttggtatagcaaactacgcacagaacgttccaggcagagtcacgattaccgagacaaatccacgacgcacagcctacagngganctgacgcagcctagagatcgtaggacggacacggtccgtagtattacgtgtagacggagacgatcgagtagttaggtttacttgtcgttaccggg

SEQ ID NO: 173271 - DNA, 525 bp, Homo sapiens
  misc_feature: GYAE6OF01A25QR.48.79.H02.1.454.CMB.1.raw
  modified_base (288)..(288): a, c, t, g, unknown or other
  misc_feature (288)..(288): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcggtgaaggtctcctgcaaggcttctggaggcaccttcagcagctatgctatcagcgtgggtgcgacnggcccctggacgaagggcttggagtgggagtgggaggatcgatcccttatcgtttagtatagcaaactacgcacagaagttcgaggcagagtcacgattaccgcgacaaactccacgacncacagacctacagtggagctggacnctacgcctagagatcgagaggacaccggtccgtagtacttcgtggtgacggagagatacgagtagttaggtttattagttccggttaccggg

SEQ ID NO: 173272 - DNA, 641 bp, Homo sapiens
  misc_feature: GYAE6OF01BHK1L.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagagcctgggtcctcggtgaaggtctcctgcaaggcttctggagcaccttcagcagctatgctatcagctgggtgcgacaggcccctggacgaagggcttcggagttggagttggggaggactcgtactcccttagtcgtttggtatacgtacaaacgtacgacaacgagtaacgttccaagggtcaagtagtcgaacgtacttaccggacggtaactaaacgtcccgaacggacgtaccgaactacgacccttacgacgttacgggacgacgttcggaagccgaaggaccctagggtacgtaacttcggtacgggaacgggtaccgaaccgggtccgtttacggtaacgtttaccggtcggttaggacggtaaggacggtaactacggtacggtaaggtttacgggtttaacttccggttacggtttaacccgggg

SEQ ID NO: 173273 - DNA, 559 bp, Homo sapiens
  misc_feature: GYAE6OF01EQT0F.48.79.H02.1.454.CMB.1.raw
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttctggaggcaccttcagcagctatgctatcagctgggtgcgacgaggcccctggacaagggcttggagtggagtgggaggatcagtcctatcgtttggtatagacaaactacgcacagaagttccgaggcagagtcacgtattaccgacgaacaaagtccaacgngacacagccctanagtggacncgtagacgcgaacgcctaggaagtatcgtaggacggaccgaccgggtccgttagttaacgtttacgtggttacggacggaggtagacgtacgtaacggtaggtttaggtttatttcgtccgtttaccgggg

SEQ ID NO: 173274 - DNA, 646 bp, Homo sapiens
  misc_feature: GYAE6OF01A6FKN.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcggtgaaggtctcctgcaaggcttctggaggcaccttcagcagctatgctatcagctgggtgcgacgacggccctggacgaagggcttgagtggagtgggaggatcgatcctatcgtttaggtatagacaaactacgcacgaagaacgttccgaagggcaaggagttaccgaacggtagttaccccggacggtaaacctaaaacgtacccgaacgaacgaccgaaccgacggtaccctaacgtacgttcgggaacgtcgtaggacgaccgacggtaccctaggaacggtactttacggacggtaacgggaaccgaccgggtcccgttaagggtttaaccttacggtaggtcggaccggtaggtaacggagtacgtaagggttaagggtttagttttaacgttaacgttccgggttaacccggggg

SEQ ID NO: 173275 - DNA, 632 bp, Homo sapiens
  misc_feature: GYAE6OF01A6QWA.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgagaagccgtggtccgtcggtgaggtctcctgcaggcttctggaggcaccttcagcagcgtatgctatacagcgtggtgcgacacggccccgtacggacgagggacgttgaggtggagtgggagggagtcgtacgtcctagttctttggtagtagacaaactacgcacagaagttccgaggcgagtagtccgacgattaccgacggaacaaactccgacgaacgccaaccgacgtaccctacacgtgggacgcttaggaacgccgaacgcccgtcgggaagtaccgttcgtacggtaacgggaccgtaaccgggcccgtttagggtaacttttaaccgtcgggttaagcccgggaagaacggtaattacccggaagggttaagggtttacgggtttaaacgttttacgttccccggtttacccgggggg

SEQ ID NO: 173276 - DNA, 575 bp, Homo sapiens
  misc_feature: GYAE6OF01EL6VJ.48.79.H02.1.454.CMB.1.raw
  modified_base (354)..(354): a, c, t, g, unknown or other
  misc_feature (354)..(354): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggagcaccttcagcagctatgctatcagctgggtgcgacgaggccccgtggacagggctgagtgggatgggaggatcactcctatctttggtatagcaaactcgacanagagttccagggcagtacgtcgaacgtacttaaccgacggtaacaaaacgttcccgaaacgacggtacccaaccgaacggtaccctaacgaacgttcggggaactcgtaggaacgcaacggccctagggtaacgagttcgtaggacggacgacggtccgtgtaacgttacgtggtagcggaggagatacgtagtaaggttggtttattgtccgttaccggg

SEQ ID NO: 173277 - DNA, 587 bp, Homo sapiens
  misc_feature: GYAE6OF01E31QC.48.79.H02.1.454.CMB.1.raw
  modified_base (456)..(456): a, c, t, g, unknown or other
  misc_feature (456)..(456): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagcctgggtcctcggtgaaggtctcctgcaaggcttcgtggacgctaccttcagcagctatgctatcagcgtgggtgcgacacggccccgtggacgagggcttggagtggagtgggaggatcgactccctattcgtttggtactagactaaactacgcaacgagtaacgttccgagggcagacgtcaacgtagttacccgacgtaacaaactccgaacgacgaccaacgacgacctacgagtggacncgtagacgccgagcccgtaggacgtatcgtacggacgggtacccgaccggtccggttagtacgtttacgtggtacggacggtaagagtactacgagggttagttaggtttactttacgtcgttacccgggg

SEQ ID NO: 173278 - DNA, 568 bp, Homo sapiens
  misc_feature: GYAE6OF01DL798.48.79.H02.1.454.CMB.1.raw
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
  modified_base (531)..(531): a, c, t, g, unknown or other
  misc_feature (531)..(531): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagccgtgggtcctcggtgaggtctcctgcaaggcttcgtggaggcaccttcagcagctattgctancagcgtgggtncgacgacggcccctggacagggcttgagtggagtgggaggatcgatccctagttcgttggtanacgtacaaactcgacacgagtaacgtcgaggnagagtacgacgtacgttaccgacgaacaaatcccgaagcgacacgacgcctacgagtacggacgctagacgcgacgcccgtagacgtacgtcgtaaggaccgggaaccgtaccggcgtagttaacttacgtggtacgtacggagacgtanacggtagtaggttacgtttattacgtccggttaccgg

SEQ ID NO: 173279 - DNA, 581 bp, Homo sapiens
  misc_feature: GYAE6OF01CJ98I.48.79.H02.1.454.CMB.1.raw
  modified_base (311)..(311): a, c, t, g, unknown or other
  misc_feature (311)..(311): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagcgtgggtgcgacaggcccctggacaagggcttgagnggagtgggaggatcgatccctatctttaggtatagacaaactcgcaacgagaacgttccgagggcacgagtccgaacgacgttaccggacggaacaaagtcccgaaggaacgacctaacaacggccctaaccgagtacgggacgtcgtaggaacgcgtaacggccctaggaacgtatcgtaggaacggaccgaacggtccgtagtacttacgtggtagacggagacgtacgtacgaggtagttaggtttattagtcccgtttacccgggg

SEQ ID NO: 173280 - DNA, 546 bp, Homo sapiens
  misc_feature: GYAE6OF01BAVO8.48.79.H02.1.454.CMB.1.raw
  modified_base (511)..(511): a, c, t, g, unknown or other
  misc_feature (511)..(511): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagcgtgggtgcgacgacggcccctggacaagggcttggagtggagtgggagggtatcatcccttatcgtttggtatagacaaactacgacacagaacgttccgagggcagagtcacgacttaccgacggacaagtccacgagacacgacgaccctacgagtggacgcgtgagcgacgcccgtaggagacttcgtaggacggaccgacggccgttagtacttacgtgtaggacgagagntacgtaaggtagttagttacttagtccgttaccgg

SEQ ID NO: 173281 - DNA, 514 bp, Homo sapiens
  misc_feature: GYAE6OF01CRUKP.48.79.H02.1.454.CMB.1.raw
  modified_base (248)..(248): a, c, t, g, unknown or other
  misc_feature (248)..(248): n is a, c, g, or t
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctggggtcctgggtgaaggtctcctgacaaggcttcnggagcaccttcagcagctatgctatcagctgggtgcgacaggcccctggacaagggcttgagtgatgggaggatcgatcctatcttaggatagcaaaactcgacacagaagttccagggacagagtacaggtaactacgcgacaaatccaagagacacagcctacataggacntgagcagcctgagactcgtagaggacacgccgttagtattacgtggtancggagtacgagttcagggaattgttacttaatcgtttacccggg

SEQ ID NO: 173282 - DNA, 656 bp, Homo sapiens
  misc_feature: GYAE6OF01AVXIP.48.79.H02.1.454.CMB.1.raw
  modified_base (343)..(343): a, c, t, g, unknown or other
  misc_feature (343)..(343): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctggaggtgaagaagccgtgggtcctcggtgaaggtctcctgcaaggcttcgtggacggctaccttcagcagctatgctatcagtcgtgggtcgcggacgaccggccccgtaggacgagggtcttaggaggtgggagtggggagggntcgtacgtccttagttctttaggtatacgacctaaacgtacgacaacgtaaggtaacgttccgagggtaccaggacgtacctaacggtacttaccggacggaactaaacgtccgaacgagaccaacgacgacctacgagtcggagtctaggagcgaacgtccgaggtacgtctcgaggaccggtacgtaccgggtaccggttagttaccgtttacggtcgggtaggacggaaacggtaacgtacgttaaccggtaagggttaacggggttttaaggttttaacgtttacggttccccgggtttaaaccggggg

SEQ ID NO: 173283 - DNA, 541 bp, Homo sapiens
  misc_feature: GYAE6OF01ERIMT.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacgacggcccctggacaagggcttggagtggatgggaggatcatcctatcgtttggtatagcaaactacgacacagaacgttccgaggcagagtcacgtacttaccgcgaacaaatccaacgacgacacagcctacagtggagctagacgcacgccgtagacgtatcgtaggacggaccgacggtccggttagtacgttacgtcgtgacggtagacgagtacgtaggtaggttaggtttaacttgtccgttaccggg

SEQ ID NO: 173284 - DNA, 599 bp, Homo sapiens
  misc_feature: GYAE6OF01BRF1I.48.79.H02.1.454.CMB.1.raw
  modified_base (296)..(296): a, c, t, g, unknown or other
  misc_feature (296)..(296): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctggaggtagaagacgccgtgggtcctcggtagaaggtctcctgcgaaggtcttcgtggaggccaccttcagcacgctatgctatcagtcgtggggtcncgacgaccggccccgtaggaccgtagggtcttggaggtggagtggggaggatcgactcctatcgttaggatagacaactacgacacagacgtacgaggacagtagtacgacgtaacgtaccgacgaacaaactaccgacgagaccacacgtaccctagagtcggaagtcaggacgacgagccgtagagtacgtcgtacggacggaccgtaccgggtccgttaagtacgtttacgtcggtagacggtaaggagtaccgtagtaagggttaggtttagtttaacgttcgttccggttaacccggg

SEQ ID NO: 173285 - DNA, 586 bp, Homo sapiens
  misc_feature: GYAE6OF01EOZL7.48.79.H02.1.454.CMB.1.raw
  modified_base (328)..(328): a, c, t, g, unknown or other
  misc_feature (328)..(328): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttcgtggaggcaccttcagcagctatgctatcagcgtgggtgcgacgacggccccgtggacgaagggcttggagtggagtgggaggntcactcctatctttggtatagacaaactacgcacagtaacgttccgaggcagacgtcaacgtacttaccgacggaactaaactccgaacgacgaccaacgacgaccctaacagtcggaagcgtagacgccacggcctaggacgtatcgtaggacggtaacaccgggtcgttagttaacttacgtggttaggacggtaagagtaacgttacggtaaggtaaggtttaggtttaattttacggttccgtttaacccgggg

SEQ ID NO: 173286 - DNA, 626 bp, Homo sapiens
  misc_feature: GYAE6OF01BVXNT.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttctggaggcaccttcagcagctatgctatcagcgtgggtgcgacgacggccccgtggacgaagggcttggaggtggagtggggaggatcactcctattcgtttagtatacgacaaacgtacgacacgagtaacggttccgagggactaggacgtacgacgtacgttaccggacggtaacaaacgtaccaacgacgaccacgacgaccctacgacgtggacgctaggacgcgacgcccgtaggaacgtactcgtaggacgggaccgacccggggtaccgtttacggttaacgtttaccggtaggttacggacggtaacggaaggtacgttacgtaacgggttaggtttagggttttaacgttaacggttcccggtttacccgggg

SEQ ID NO: 173287 - DNA, 586 bp, Homo sapiens
  misc_feature: GYAE6OF01A8S7R.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagcctgggtcctcggtgaggtctccgtgcaaggtcttcgtgggacggcaccttcgagtcagctatgctatcagcgtgggtgcgacgacggcccgtggacgaagggtcttggagtggagtggggaggagtcactccgtatcgtttggtaactagacaaacgtacgcacagtaacgttccgaagggcaggtacgtacgacgtacgttaccggacgaacaactccgacgaacgacgacacgacctacgagtacggagtcgtagacgaccgacgtccgtagacgtactcgacggacggaccggaccgggtcgtcggttacgttacgtggtacgacggagacgtagtacgtaggtacggttagttatttccgtcggttaaccggg

SEQ ID NO: 173288 - DNA, 524 bp, Homo sapiens
  misc_feature: GYAE6OF01AHLL3.48.79.H02.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (322)..(322): a, c, t, g, unknown or other
  misc_feature (322)..(322): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagcctgggtcctggtgaggtcncctgcagtcttnggagcncttcagcagctatnctatcagcgtgggtgcgacgacggccctaggacgagggcttggaggtggagtgggaggtntcacttcctagttcgttagtatacgacaacgttacgctacgagtacgtcgaggcagacgcagacgttcgacganaacncagancanacgctagagngacnctgacgtnacggtcagtntagcgtaggacgtaccgcgacgttagtactacggtgtacggacggtaatagggatcgagtacgttagttctagtcgtaaccggg

SEQ ID NO: 173289 - DNA, 579 bp, Homo sapiens
  misc_feature: GYAE6OF01DH371.48.79.H02.1.454.CMB.1.raw
  modified_base (392)..(392): a, c, t, g, unknown or other
  misc_feature (392)..(392): n is a, c, g, or t
  modified_base (470)..(470): a, c, t, g, unknown or other
  misc_feature (470)..(470): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctggaggtgaagaagccgtgggtcctcggtgaaggtctcctgacgaaggtcttcgtggacggctaccttcagccagctatgctatcgacgcgtgggtgacggaccgacggtccccgtaggacgtaagggtcttaggacggtggaggtgggagatcacgttcctattcgttagtaatacgactaaacgtcgacgaanaggtacgtcgaggctagacgtagacgtacgtaccgacgaacaactccgaacgacgacacgaccgactacgagtaggcncgtagacgacacggtcagtacgatcgaacgcgacgacgtcgtacgtagttacggtcgtaggacgaagcgagtacgtaggttaagttcgtttattacgtcgttaaccggg

SEQ ID NO: 173290 - DNA, 580 bp, Homo sapiens
  misc_feature: GYAE6OF01ACMGV.48.79.H02.1.454.CMB.1.raw
  modified_base (289)..(289): a, c, t, g, unknown or other
  misc_feature (289)..(289): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagcgtgggtgcgacncggccctggacagggcttggaggtggagtgggaggatcactcctattcgtttaggtatagacaacgtacgacacagtaacgttccgaggcagacgtcacgtacttaccggacgaacaaactccgaacgacgaccacgtacgaccctaacgagtcgggacgtcgtaggacgcgacgccgtaggagtactcgtaggacggaccgtacggccgttagtacgttacgtggtaggacggtaggacgtacgtacgtaaggttaggtttaggtttatttcggtccggtttacccgggg

SEQ ID NO: 173291 - DNA, 601 bp, Homo sapiens
  misc_feature: GYAE6OF01BGTZ3.48.79.H02.1.454.CMB.1.raw
  modified_base (327)..(327): a, c, t, g, unknown or other
  misc_feature (327)..(327): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcggtgaaggtctcctgcaaggtcttcgtggaggcaccttcagcagctatgctatcagcgtgggtgcgacgacggcccctggacgagggcttgagtggagtgggaggntcactcctattcgttggtatagacaaacgtacgacacgtagaacgttcgaaggcaggagtacaacggtacttaccggacggaaacaaacgtaccgacgaacgccgaacacggtaccctaacgagtacggacgcgtgaacgcgaacggctaggagtacttcgtaggaccggaccgaccgggtccgttagttaacgtttacggtcggttagaccgggagaacgtacgtacgtaagggttaaggttaggttttaattccgttaccggttaaccgggg

SEQ ID NO: 173292 - DNA, 634 bp, Homo sapiens
  misc_feature: GYAE6OF01EHXHB.48.79.H02.1.454.CMB.1.raw
  modified_base (262)..(262): a, c, t, g, unknown or other
  misc_feature (262)..(262): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagcctgggtcctcggtgaaggtctccgtgacaaggtcttcgtggaggctaccttnagcagctatgctatcagtcgtgggtcgcgacgcggccccgtggaacgagggtcttggagtggagtaggggaggtatcacttcctagttcgtttaggtactagactaaactcgacaacgtacgtaacgtccgaagggcaaggtacgtaccgtaacgtacgttaccggacgaaacctaaacgtccgaacgacgacccaacgtaccgaccttaagagtacgggacgtacgtaggaacgcgaaccggtccgtaggaacgttcgtacggacggacgggaccgtaccgggtacgttcgttaacgttacggtggtcgaacggtagacgtaaccgtacgtaagggttagtttagtttacttacgtcccggtttaccgggg

SEQ ID NO: 173293 - DNA, 605 bp, Homo sapiens
  misc_feature: GYAE6OF01E402U.48.79.H02.1.454.CMB.1.raw
  modified_base (451)..(451): a, c, t, g, unknown or other
  misc_feature (451)..(451): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcgggtgaaggtctcctgcgaaggcttcgtggaggcaccttcagcagctatgctatcagcgtgggtcgcgacgacggccccgtggacgaagggtcttggagtggagtggggaggtatcacgttccctagttcgtttaggtatacgactaaacgtcgacacgaagtacgtcgaggcagacgtcaacgtattaccgacggaacaacgtccgacgacgaccaaccacgaccctanagtcgggactccgtaggacgccaacgtccgtaggaagtacgtcgtaggaaccggccgtaccgggtaccgttagttaacgttacgtcgggttagaacggtaggtacgagttacgagggttaacgtttggtttaaccttcgtccggtttaaccggg

SEQ ID NO: 173294 - DNA, 512 bp, Homo sapiens
  misc_feature: GYAE6OF01CVOES.48.79.H02.1.454.CMB.1.raw
  modified_base (405)..(405): a, c, t, g, unknown or other
  misc_feature (405)..(405): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatcgtttggtatagcaaactacgcacagaagttccagggcagagtcacgtataccgacgacaaatccacgagcanagcctacatggagctgagcaagccgtagacgtatctagacggacaccggccgtagtattacgtgtcgcgagagtagtcaaggagttggtttaattatcgttaccggg

SEQ ID NO: 173295 - DNA, 616 bp, Homo sapiens
  misc_feature: GYAE6OF01CWQKK.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctggtgaaggtctcctgcaaggtcttcgtggacggcaccttcagcagctatgactatcgagcgtgggtgccggaccacggcccctagggaaccgtaagggtctttaggacggtaggtagtgggggagggacttcgacttcccttagttccgttttaggtaattacgactaaacgtcgacaacgagtaacgtccgaggtcaggacgtcgaacgtacgttaccggacgtaacaaactcccgaacgacgaccaacgacgtaccctaagcgtagggacgcgtagacgacgagccgtagaacgtctacgtaggacggaaccgtcgggtaccgtagttacgttacgtgggtagacggtagaggtatcgtaaggtacgtttggtttaacttcgtcggttaccggg

SEQ ID NO: 173296 - DNA, 564 bp, Homo sapiens
  misc_feature: GYAE6OF01B20QW.48.79.H02.1.454.CMB.1.raw
  modified_base (467)..(467): a, c, t, g, unknown or other
  misc_feature (467)..(467): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttcgtggaggcaccttcagcagctatgctatcagtcgtgggtgcgacgacggcccctggacgagggctggagtggagtggggaggatcatccctattcgttggtatagacaaactacgcacgagtaagttccgagggcagagtcacgtacttaccggacggaaccaaacgtcccgaacgacgaccacgacgccctaagagtcggagctgacgccagccgtaggagntcgtaggacggacaccgggtcgttaggttaaccttgtggtcggacggaagacgtagtcgtaaggtaggttaggtttacttagttccggttacccggg

SEQ ID NO: 173297 - DNA, 538 bp, Homo sapiens
  misc_feature: GYAE6OF01DR2H7.48.79.H02.1.454.CMB.1.raw
  modified_base (282)..(282): a, c, t, g, unknown or other
  misc_feature (282)..(282): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtncgacacggcccctggacgaagggcttggagtggagtgggaggatcatccctattcgtttggtatagacaaactacgacacgagtaacgttccgaggcagagtcaacgacttaccgacgaacaaatccgaacgagcacagcctagagtaggagctagagacgagaccgtagacgatcgtaggacgacgtaccggtcgtagtacttacgtgtagacggagagtatacgagtagttagtttactagttcgttaaccggg

SEQ ID NO: 173298 - DNA, 606 bp, Homo sapiens
  misc_feature: GYAE6OF01DWJHL.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcacttcagcagctatgctatcagctgggtgcgacgaggccccgtggacgaagggcttgagtggagtgggaggatcatcctattcgtttggtaatagctaaactacgcaacgagaacgttccgaagggcaagagtacgaacgtacgttaccgacggaaacaaactccaacgacgaccaacacgccctaacgagtacgggaacgcgtacgacgccgtacggcccttagggacgtagttcgtaggacgggaccaccgggtacccgttaggttacttaccgggttgtaggcggtaaagaacggtagtacggtaaggttaacgggtttggttttaaacttacgtttccgtttacccgggg

SEQ ID NO: 173299 - DNA, 830 bp, Homo sapiens
  misc_feature: GYAE6OF01COF0F.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagacgccgtgggtcctggtagaaggtctccgtgacgtaaggtcttcgtgggacggacctaccgtttcgagtaccgaggtccttaagtcggtaccttagtaccgtaacggtccggttggggggttacggaccggaaccggtaccggggtaccccccggttaaggggaaccggtaaacgggggttccgttttaggggaacgggttagggtaaggggttacggggggtacgggtaacgtttacccgtaacgtttacccccgtttaagttttaccggttttaacgggttaacgttaaacggtaaccgtaaaaaccggttaccggaacccgaaaccgtaaacgggttaaacggtttcccggaaagggtaccgtaaggtaccgtaaccgtaaccggtaaccgtttaccccggggaaccggaaaacctaaacccggttaccgaaaccggaacgacccgtaaccgaacgtaccccgttaagacgttacgggacgtccgtaaggacgtaccgagtccgtagacgtagttcgaacggacggacgtaccgggttacgtacgtttacgtacgtcggtagacggtaaggacgtaggtacgtaaggttaggttagtttacgttcgttccggttaacggg

SEQ ID NO: 173300 - DNA, 510 bp, Homo sapiens
  misc_feature: GYAE6OF01B12GK.48.79.H02.1.454.CMB.1.raw
  modified_base (352)..(352): a, c, t, g, unknown or other
  misc_feature (352)..(352): n is a, c, g, or t
  modified_base (453)..(453): a, c, t, g, unknown or other
  misc_feature (453)..(453): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcagtcctatctttggtatagcaaactacgnaacagaagttccaagggtcagagtcacgattaccgacggacaaactccaacgaagcacagcctaacatggagctgagcaagcctagacgatctagaggacncggccgtggtattacgtgtgacgagagatcaggacgttaggttattagtcgtaccgg

SEQ ID NO: 173301 - DNA, 657 bp, Homo sapiens
  misc_feature: GYAE6OF01E0CYP.48.79.H02.1.454.CMB.1.raw
tcagagtatacatacacgaccggtgctcgatttagtgtcacacgaagggaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcggtgaaggtctcctgcaaggcttcgtggaggccaccttcagcagctatgctatcagcgtgggtgcgacgacggccccgtggacgagggcttggagtggagtgggaggatcactcctattcgtttggtatagactaacgtacgacacagtacgtaccgagggcaggtacgtacaacgtacttaccggacggaacaaactcccgaacgacaccgacacgtaccctaacgagtcggagtccgtaggacggtcgaacggtccctagggaacgtacgttacgtagggaaccgggtaacccgaccgggggttacccgtttaggtttaaccgtttaacccgggttaggttacccgggacgggtaaacggtaagggtaactaccggttaaagggttagggttttaagggtttaacgttttacgttcccgggtttaaacccgggg

SEQ ID NO: 173302 - DNA, 590 bp, Homo sapiens
  misc_feature: GYAE6OF01BIE8A.48.79.H02.1.454.CMB.1.raw
tcagagtatacatacacgaccggtgctcgattttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtcctcctgcaaggcttcgtggaggcaccttcagcagctatgctatcagtctgggtgcgacacggcccgtggaccgaagggcttggaggtggagtggggaggatcactcctatcgtttggactacgacaaactcgacacagaacgttccgagggcaggacgtacacgtactaccgacgaacaaactccgaacgacgccaacgacgacctacgagtcggacgctaggacgtcgacggtccgtagggacgtacgttcgtaggacggacgaccgggtaccgttagtaacgtttacgtggttacggcggtaacgagtactacggtaaggttagggttaggtttaacttcgtccgttacccggggg

SEQ ID NO: 173303 - DNA, 678 bp, Homo sapiens
  misc_feature: GYAE6OF01BSQZM.48.79.H02.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctggaggtgaagagcctgggtcctggtgaggtctccngcaggcttcgnggaggcaccttcagcagctatgctagtcaggcgtgggtcacgacgacggcccctggacgagggtcttggaggtggacggtggggaggactcgactccgttagttcgttaggtactacgtacaaacgtacgactacgagtaacgttccggagggtcaagacgtacgaacggttacgtaaccggacggaactaaacgtcccgaaggacctacgaaccgaaccgtaccgtaacgacggtacggtagtaccgtcgggaacgtccgaacggtacccgagggtacgtaaccgttcggaacgggaaccgggtacccgtaaccggggtacccgttagtttaacgttacccgttaggttaccgggacggtaacgaacggttaacgtacggtaacgggttaaggttaggggttttaacttcggttaccccgggttaaccgggg

SEQ ID NO: 173304 - DNA, 805 bp, Homo sapiens
  misc_feature: GYAE6OF01DD5MD.48.79.H02.1.454.CMB.1.raw
  modified_base (763)..(763): a, c, t, g, unknown or other
  misc_feature (763)..(763): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtgcagcagctacaggtgtcccagtcccaggtgcagctggtgcaggtcgtgggggctggaggtagaaaggaacgtccgtggggtccctcggggtgaacgggtcctccgtggacgtaacggtctttccggtggacggtcctaacccgtttcgaagccgtaacggccgttaagttcggtacctttaagttcccgaagggtccggtttggggggttacgacccggtaaccggacccggggtacccccccggttaaggggaacccggtaaacgggggttcccgttttaggggaacgggtttaggggtaacgggttaggggggaacgggtacgtttacccgtaaccgtttccccgtttaacggttttccggttttaagggttaacgtaaccggtaacgtaaaaaccgttccggaactaacgggtaagttaacccggttacggacgggtacgaaggtacgtaccgaacgtacgtacccggacggaaacctaacgtaccgaacggacgaccgaaccgacgtacccgaagtagtcggacgacgtagacggcacggtaccgtagacgtacgtacgacggacgaaccggtacggtcgtacgttaagttcgtcggtaggacgaggtacgngtaacggtaggttacgttaggttacttacgtcggttaccggg

SEQ ID NO: 173305 - DNA, 680 bp, Homo sapiens
  misc_feature: GYAE6OF01BOIHE.48.79.H02.1.454.CMB.1.raw
  modified_base (248)..(248): a, c, t, g, unknown or other
  misc_feature (248)..(248): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagccgtgggtcctcggtgaaggtctcctgcaaggcttcgnggagcaccttcagcagcttatgttatcagtcgtgggtgcgacgacggcccctaggacgagggcttgagtggagtgggagggtactcgtacgtcccgtattcgtttaggtaagttacgaccgtaaaacgttacggactaacgtaacggtaaacggtttcccggaagggtaccgtaaggtacggtaaccgtaaccgggtaacgtttaaccccgggaaccgggtaaacctaaaacccgttcccggaaaccgaacggtaacccgaaaccgtacgggtaaccccttaaacgtacggtacgggtacgaccgttggaaaccgtcgacgtacccgtagacgtaacgtcgtagacggacgacggtcgtagttacttacgttggacgtacggagtacgagtactaagggtacgttaggttattactcggttccggtaacggg

SEQ ID NO: 173306 - DNA, 654 bp, Homo sapiens
  misc_feature: GYAE6OF01B4LQ4.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggagttcctcttgtggtgcagcagctacagtgtccagtcccaggtgcagctggtgcagtcgtgggctgaggtgaagagccgtgggtcctcggtgaaggtctcctgcaggtctgtggagcctacttcagccagtctatgctagcagtcgtgggtcgcgacgccggcccgtggaaccgtagggtcttggaggtggtaggtggggaggactccgaacttcccgttagttcgtttagggtaactacgtaaccctaaaacgtaccgactaacgtaacggtaacgttcccggaagggtcctaaggtacgtaccgtacgtacgttaaccgacggaaactaacgtaccgtaacgcgtacaccgtacggtaccctaagacgtacggacgtcgaaggtacgcgtaagccgtaggaccgtagttcggaacggacggtaccgtaccgggtaccgttacgtaacgtttacgtgggttacacggtagaaccgtagttaacgaggtttacggtttaggtacgtttaagtccggtttaaccggg

SEQ ID NO: 173307 - DNA, 844 bp, Homo sapiens
  misc_feature: GYAE6OF01BBGF0.48.79.H02.1.454.CMB.1.raw
tcagagtatacatacacgaccggtgctcgatttagtgtcacacgaagggaaaggggatcacataacaaccacattcctcctctaaagaagccccctgggagcacagctcatcaccatggactggacctggaggttcctctttgtggtggcagcagctacaggtgtccagtcccaggtgcagctggtgctagtcgtggggctggaggtgaagagccgtgggtcctgggtgaacggtcctccgtgctaggtcttcgtgggacggtcctaccttcgagcacgtaccttatcgtacttacgtcgacggtcggtggggttcgacccggtaaccggaccgggtcccccggtaggggaaaccggtaacgggggtcctttagggacgggttagggtaagggttagggggaacgggtacttaccgtaacccgttaccgtttacggtttacgtttttaacggaacttaaccggaacgtaaaacccgtaccgtaaccgaacgtaaaccggttaacgggttacccggaacggggtacgtaacgggtacggtaacccggtaacccggttaaccggttaaccccgggaacggtaaaaccccgtaaaacccggtaacccgtaaaccggaaaccggaacccgtaaccggtaacccgtaacccgttaaacgacgggttaacgggtacgtaccggtaggaaccggtccgaacggtccggtagacggtagtacgtacgggtacgacccggtacggtaccgttaggttaaccgttggtccggttaaggacggtaaacggtcggtaacgtacggtaaggttagggttttaagtttacgtttaccggtcccggggtttaacccggg

SEQ ID NO: 173308 - DNA, 659 bp, Homo sapiens
  misc_feature: GYAE6OF01BR12K.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtggtcctcggtgaggtctcctgcaggtcttcgtggacgctaccttcagactagctagtgctatcagtcgtggtcgcgacgcggccccgtaggacgaacgggtcgtaggaggtcgggtaagtggggaggtactcgtacgttccttagttccgtttagtatacgactaacgtacgtacacgtagtacgtacgagggacaggacgtacacgtactaccggaacgtaacaaccgtacgaaccgtagacccaaccgtagtaccccgtaagtacggtaacgggactacgtacggacgaccgacggtacccgtagggtacgtaccgttcgaacgggtaacgtaccccgggtacgggttaccgtttacgttaaccggtttaaccgcgggttaagaccggagtaacgacgttacggagttcggtttaatttaggttaaccgtcggtttaacccggg

SEQ ID NO: 173309 - DNA, 611 bp, Homo sapiens
  misc_feature: GYAE6OF01BJJ5S.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttcgtggaggcaccttcagcagctatgctatcgagcgtggtgcgacgcggtcccctggacgaagggcttggagtggagtggggaggatcactcctattcgtttagtatagacaaactcgacaacgagaacgttccgaggccagacgtacgacgtacttaccggacgaacaaactccgaacgacgaccacacgtacctaacgagtcggagctaggacgacgacgtccgtaggacgacgttacgaggaaccggaccggtaccgggtcccggtttagtaaaccgttttacggtacgggtaggaccgggtaaggtaacgtacggtacgtagggtaaggtttaggttttaacgttacgtttcggttaacccgggg

SEQ ID NO: 173310 - DNA, 686 bp, Homo sapiens
  misc_feature: GYAE6OF01CI2TJ.48.79.H02.1.454.CMB.1.raw
  modified_base (250)..(250): a, c, t, g, unknown or other
  misc_feature (250)..(250): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgagagctggtcctcggtgagtctctgcaggctcgtggagctaccttnagcagctatcgctagtcagtcgtgggtacgcgtacgacggtccccgtaggaccgaagggtcgttaggagtgggagttaggggacggtataccgtacgttcccgttagtttaccgtttagggtaattaaccgacgtaaaacgtacgacctaaacggtacgtaaaacgttccgggaacgggtaccaaggttaccgaacgtaaccggaacgtttaaccccgggaccgggtaaaacctaaacggttaccccggaaaggtaacccgtacgaacccgaccgtacccttaacgagtacgggagtaccgtaggaacgcaccggtaccgtgaacgtgtaccgtaggacggtaaccgcggttaccgtcgttaacgttcggtttggagacggtaagacgtaagacgttaaggtacggtttgttaaccgttacgtcggttaacccggg

SEQ ID NO: 173311 - DNA, 692 bp, Homo sapiens
  misc_feature: GYAE6OF01CNA7Y.48.79.H02.1.454.CMB.1.raw
  modified_base (246)..(246): a, c, t, g, unknown or other
  misc_feature (246)..(246): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagcctgggtcctcggtgaggtctcctgcaaggcttcgnggacgcaccttcagacagctatgctatcagtcgtggtcgcgtaaccgacggccccgtggacgtaacgggctttagggacgtggaggtagggagggtactcaacgttccctagtttcgtttaggtataacgtactaaacgtacgaccaaactacggtaaagttccccgaaggggacctaaggtacgtacgtaaccggtaacgttaacccgacgggaaaccaaatcccgaaacgacgacctacgaacgtacccttaacgacggttagggacgtaccgttaggacgaaccgacgtacccgtaggacgtacgttacggtacggaacgggaccgtaccgggtacgttaggtttacgtaccgtggttaacggaccggtaaggtaacgacgttaacggtaagggtttaacggtttaggtttaaaccgttacggttccggtttaaacccggggg

SEQ ID NO: 173312 - DNA, 604 bp, Homo sapiens
  misc_feature: GYAE6OF01CZOM6.48.79.H02.1.454.CMB.1.raw
  modified_base (247)..(247): a, c, t, g, unknown or other
  misc_feature (247)..(247): n is a, c, g, or t
  modified_base (391)..(391): a, c, t, g, unknown or other
  misc_feature (391)..(391): n is a, c, g, or t
  modified_base (452)..(452): a, c, t, g, unknown or other
  misc_feature (452)..(452): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggtcttcgnggacggcaccttcagcagctatgctatcagtcgtgggtgccgacacggccccgtggaacgagggtcttggagtggagtgggaggatcatccttattcgtttaggtatacgactaaacgtcgacaacgagtaacgtcgaggcagngtacacgacgtaccgacgacaaacgtccgaagacaccacacgacctagagtgacgctgacncgagtccgtagacgtcgtacgtaggacggaaccgtaccgggtaccgttaggttacttaccggtggtacggtacggtaacggacggttaacgtacggttaaacgggtacggttttaagggtttaactttccgttacccggttttacccggggg

SEQ ID NO: 173313 - DNA, 785 bp, Homo sapiens
  misc_feature: GYAE6OF01B8YFZ.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagcctgggtcctcggtgaaggtctcctgcgtaaggcttcgtggaggcctaccttcagtcagctagtgctatcagtcgtggtgccgacgacggtccccgtaggacgaagggtcgttacggaggtaggaggtaggggacgggtaactcgtaaccgttcccgttacttcgtttaggtaacgtaacgacgtaaaacccgtacggaccgtaacgtaaacggtaaccggtttaccggaacgggtacgtacggtaacggtaccgtaaccggttaaccgttaacccgggacgggaaaaccctaaacccgtaacccgaaccggtaacgacccgaacgtacccgtaacccgttaaacgtaggtacgggtaacgtacgttaaggaccggtacgtaaccggtacccggttaggtaacccgtagttacccgggtagggtaaacccgggtacccggttaccggggtaccgtttaacggttaacgggtttacggtcggggttacggaacgggaagttaacccgtaaggttacccgtaacgggttagggttttaaggtttaaacgttttcccggttaccggtttacccggggg

SEQ ID NO: 173314 - DNA, 582 bp, Homo sapiens
  misc_feature: GYAE6OF01E5D6S.48.79.H02.1.454.CMB.1.raw
  modified_base (328)..(328): a, c, t, g, unknown or other
  misc_feature (328)..(328): n is a, c, g, or t
  modified_base (410)..(410): a, c, t, g, unknown or other
  misc_feature (410)..(410): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaggtctcctgcaaggctttcgtggacggctaccttcagcagctatgctatcagcgtgggtgcgacgacgccccgtggacgaagggcttggagtggagtgggaggntcatcctatcgtttggtactagacaaacgacgacacagtaacgttccgagggcagacgtcacgtactaccgacgaacaaacncgaacgagacacacgacctacgagtcggacgtcgtagacgcgaacgtccgtagaacgtactcggtaggaaccgggaccgtaccgggtccgttagtaacttcggtggttcggaacggtacgaggtactacgggtaagtacggtttaggtttatttacgttccggttacccggg

SEQ ID NO: 173315 - DNA, 693 bp, Homo sapiens
  misc_feature: GYAE6OF01A4TEX.48.79.H02.1.454.CMB.1.raw
  modified_base (286)..(286): a, c, t, g, unknown or other
  misc_feature (286)..(286): n is a, c, g, or t
  modified_base (620)..(620): a, c, t, g, unknown or other
  misc_feature (620)..(620): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagccgtgggtcctcggtgaaggtctcctgcaaggcttcgtggaggcaccttcagcagctatgctatcagtcgtgggngcgacgacggcccgtggacgaagggtcttggaggtggagtggggaggtatcgtactcccttaagttcgtttaggtatacggactaaaccgtacgacaacgtacgtaacggttcccgaagggtcgaaggtacgtaccgaaccgtaagtttaaccccgggaccgggtaaaactaaaacgttccccgaaacggtacgacccgaaccgaacggacccttaaccgaaggttcggggaacgtacccgttagggaacgccgaacgggtcccgtaagggtaacgtcgttaccgtagggaaccgggaaccgcccgggttaccgttaggttaacgtttaccggngggtttaggcggtaagaggtacgtacgtaacgggttaggtttaggtttaattttcgttcccgggttaccgggg

SEQ ID NO: 173316 - DNA, 703 bp, Homo sapiens
  misc_feature: GYAE6OF01EUHZH.48.79.H02.1.454.CMB.1.raw
  modified_base (187)..(187): a, c, t, g, unknown or other
  misc_feature (187)..(187): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccgaggtgcagctggtncagtcgtggggctggaggtgaagacgtccgtggtccgtcggtagaacgtctccgtgacaggtcttgnggacgacncctagagcacgctagtgactatcgagtcgtgggtcgacgacgccggtcccgtaggacgtaacgggtcttaggaacgtggaggtggggtaggtactaccgtacgttcctagtttcggtttaagtacgtaacgactaaacctacgactaacgtaagtacgttaccgaggtcgaggtaacgtacgaaccggtacgttaccgacggtaaacaaacgtccgacgagtaaccacgtaccggtaccctaagtacggtacggacgtacgtacgtacgaaccgtaaccggcgtacggaagtttaccgagggtaaccgggtaaccggtacccggaacgggttttcccgttaaaggttaccgtttacggtcggtaaagaccgggtaagtacggtaaattccgggtaaaggttcggttttaaggttacttaccgggttccgtttacccggggg

SEQ ID NO: 173317 - DNA, 745 bp, Homo sapiens
  misc_feature: GYAE6OF01DMKRE.48.79.H02.1.454.CMB.1.raw
  modified_base (351)..(351): a, c, t, g, unknown or other
  misc_feature (351)..(351): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtcgcagctggtgcagtcgtggggctgaggtgaagagtccgtgggtccctgggtagaagggtctaccgtgacgtaaggcttcgtgggaacggctaccttcagcagctaatcggctatcaggcgtggggtcgacgacgacggtccccgtaggaccgtaagggcttagaggtaggtagnggggaggacttacactcccttattacgttaggtaatacggtacctaaacgtacgactaagacgtaacgttacgaacgggtcaacggagtacccgaggtaacttaccccggacgggtaaacaaaggtacccgtaacggaacgacccgtaacgtaacggtaccgtaacccgtaggtacggggtaactacgggttacgggaacgttaaccgaacgggtaccccggtaaggtacgtaacgttcggtacggaacgggtaacccgtaaccggggtcccggttaaaggttaaacctttacgggtacgggtcggttaaaccgggacggtaaacgtacgtacgggttaaacggttaaggggttttaccggtttaatttaaccgtcccgggtttaacccggggg

SEQ ID NO: 173318 - DNA, 555 bp, Homo sapiens
  misc_feature: GYAE6OF01ALB92.48.79.H02.1.454.CMB.1.raw
  modified_base (321)..(321): a, c, t, g, unknown or other
  misc_feature (321)..(321): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggccctggacaagggcttgagtggatgggagggntcatccctatctttggtatagcaaactcgcacagaacgttcagggcagacgtcacgacttaccgcggacaaatccacggagccacgacgccctaacagttgggacgcgtaggaacgtccgaacggcccgtggaagtacttcgtaggaccggaccgaccgggccgttaggttaacttaccgttggtaggacggaggacgatcgaaggtaggttaggttactttagtcgttacggg

SEQ ID NO: 173319 - DNA, 719 bp, Homo sapiens
  misc_feature: GYAE6OF01D7NOP.48.79.H02.1.454.CMB.1.raw
  modified_base (257)..(257): a, c, t, g, unknown or other
  misc_feature (257)..(257): n is a, c, g, or t
  modified_base (610)..(610): a, c, t, g, unknown or other
  misc_feature (610)..(610): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggtttcctcgttttggtggtggcagcagctacgagggtcgtccacggtcccgaggtgcagcgttgggtgcgtagtcggtggggctggaggtagaagacgccgttgggtccgtcggtagacggttccncgtgacgaacggtcttcggtggacgtccgtaccttcgacgcagtctagtcgtactagtcgaggtcggtgggtacgacggaccggaccggtaccccgtagggaacggtaacgggtcttagggcggttagggacgggtaggggacggtactactaccgttacgttagtttaggttacggtaagaacgtaaccgtaacaccgtaacaacgtaagtacggttaccgagggactaacgggtacctacgtaaccggtaccgtaacccgggaacgaaactaaccgtaccgaacgacgaaccgaacctaccgaccgttagacgtacggagcggtacacggcacggcgttaacgagttacgnggttaacgggacaccggttcgggaccgttagtaaaccgttcggagtacggaggtacgacggttaactaggtacggttagggttaatttcggtcgtacgggtttaccggg

SEQ ID NO: 173320 - DNA, 733 bp, Homo sapiens
  misc_feature: GYAE6OF01DM0SH.48.79.H02.1.454.CMB.1.raw
  modified_base (186)..(186): a, c, t, g, unknown or other
  misc_feature (186)..(186): n is a, c, g, or t
  modified_base (237)..(237): a, c, t, g, unknown or other
  misc_feature (237)..(237): n is a, c, g, or t
  modified_base (272)..(272): a, c, t, g, unknown or other
  misc_feature (272)..(272): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagctagctacaggtgtccagtcccaggtgcagctggngcagtcgtgggctggaggtagaagacgccgtgggtcctcggtgagtctcgngcgaggtctcgtggagccgtactgagcagtctatnctatcgagtcggtggtcgcggaccgaccggcccgtaggacggtaagggtcgtttaggaggtggaggtcggggtaacggtctaccgtacttacccgttagttccgttaagtaacgtacgaacctaaccgtacgaccgtaacgtacgtacgttaccggaggtacaacggtacgtacgaacccgtacgtaaccggaccgtaaactaaaccgtccgaacggacgaaccaaccgtacgtaaccccgttaagaccggttacgggaactacggtagggtaaaccggtccgaacccggttcctaacgggtagtaaccggttacgggtacgggaaccggtaaccggtaacccggttcgggtaaacgtttacgttaacgggtggtaccgggtaacgggttaacgacggttacgaaccggtttacggttaacggttttaagttcccggtttacgtaaaccccggtttcgggg

SEQ ID NO: 173321 - DNA, 624 bp, Homo sapiens
  misc_feature: GYAE6OF01D7E9K.48.79.H02.1.454.CMB.1.raw
  modified_base (332)..(332): a, c, t, g, unknown or other
  misc_feature (332)..(332): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtgggtcctcgggtgaaggttcctccgtgcgaaggtctttcgtggacggcctacccttcgagccgagcttagtgctatcagcgtgggtgcgacgcggcccgtggacgaggtctgagtggagngggaggatcactcctagttcgtttagtacagaactaaacgtacgacaacgtacgtacgttccgaggacaggtacgtcgaacgtacgttaccggaccgtaacaaacgtccgaacgacgacacacgacctaacgagtcggacgtcgtacgagtccgacgcgtaggacgtagtacgtacggaacggacccgtaccgggtcgttagtactttaacggtcggtagacggtaaggacgtaggtaacgtaacgggttaaggtttaggttttaacgttacgttcccggtttaacccgggg

SEQ ID NO: 173322 - DNA, 588 bp, Homo sapiens
  misc_feature: GYAE6OF01EMLMX.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctcggtgaaggtctcctgcaaggtcttcgtggaggcctaccttcagcagctatgctatcagcgtgggtgcgacgacggccccgtggacgaagggcttggaggtggagtgggaggatcactcctattcgttagtatacgacaaactacgacacgagtacgttccgagggcagacgtaccgacgtacgttaccggacgaactaaacgtccgaacgacgaccaacgacgtacctaacgagtggaacgcgtgacggccaggtcctagagtacgtcgtaggacggaccgaccgggtccgttaggtactttaggtcggtagacggtagagtatacggtaaggttaggttaggtttaattcgtccggttaccgggg

SEQ ID NO: 173323 - DNA, 759 bp, Homo sapiens
  misc_feature: GYAE6OF01DG8VO.48.79.H02.1.454.CMB.1.raw
  modified_base (269)..(269): a, c, t, g, unknown or other
  misc_feature (269)..(269): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggagttcctctttgtggtggcagcagctacaggtgtccagtcccaggtgcagctggtgcagtcgtggggctggaggtgaagagccgtgggtcctcggtgaaggttctcctgcgaggcttcgtggacggctaccttcagcgancctatcgctatcagtgtcgggtgaccggacgacgggccccgtaggaacgaacgggtcgtttaggagggttaggtaaggttgggggaaggtacttacccgaaacgtttccccgttaagttttaccggtttttaagggttaacgttaacggtaacccgttaaaaaccgttaccggaaccgtaaaccggtaacgggttaaaccggttttccccggaaagggggtaccgtaacgggttaaccggtaaccgtaacccggttaaaccggtttaacccccgggaaaccggtaaaaccgttaaaacccgtccccgaaaacggtacccggactaaacccgaccgtacccgtaacgagttacggacgtacgtacgacgaccgtacgccgttaggacgttacgtcgtacgagggtaccaaccgggttcgtaacgttagtaccgtggtaggaccggtaagacgatacgacggttagtttcgttaattcggtccggtttacgg

SEQ ID NO: 173324 - DNA, 666 bp, Homo sapiens
  misc_feature: GYAE6OF01BV2G0.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtggtcctggtgaaggtctccgtgcaaggtcttcgtggacgcaccttcgagcagctatcgctatcgagtcgtggggtcgcgtacgacggccccgtaggacgtaagggtcttaggagtggtacggtaggggaggtatcgacgttaccgttagtcgtttagtaagtagacctaaacgtacgactaacgtagtaacgttccggaaggtccaagtacgtactacggtacgtaacccggtacgaaactaaacgtaccgacgacgtaccacgaacgtacctaacgtaggtacggacgtacgtacggaacgtacgaccgtaccgtaggaacgtacgttcggtaagggaccggtacggtaaccggtcccgttaaaggttaccttaacggtcggtaggaacggtagaacgttacgtaccgtaagggtacgtttagggtttaacttccggttcggttaacccggg

SEQ ID NO: 173325 - DNA, 698 bp, Homo sapiens
  misc_feature: GYAE6OF01C2WKM.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggaggttcctctttggtggtggcagcagctacgaggtgtccagtcccgaggtgcaggcgtggtgcgaggtcgtggggctggaggtgaagacggccgtgggtccgttcggtagaacggttcctccgtgacgaaggtcttcgtagggacggtcctaccgttcaaggcaagcttaagtgtacctagtacgacgtcggtcgggtacgaccggtacgaccgggtccccgtagggaaccgaagggttcgttaggaggtaggaggtggggaggactcgtacgttacctagtttcgttagtactaacggaactaaaccgtacggacaacgtaagtacggtcgaaggacagacgtacaacgtacgtaccggaacgaacaactccgaagacacaacgacgcctagagtacggaacgtcgtacgaacgacgtaccggccgtaagggtacgtaccgtacggtaaccggaacggggacctacccggggttacgttacggttaacgtttcgggacggtacgacgggtaggtaacgtagtacggtaaggttagttaacgggttttacttccggtacggttacccggg

SEQ ID NO: 173326 - DNA, 587 bp, Homo sapiens
  misc_feature: GYAE6OF01BEWRQ.48.79.H02.1.454.CMB.1.raw
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (476)..(476): a, c, t, g, unknown or other
  misc_feature (476)..(476): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagccgtgggtcctcggtgaaggtctcctgcaaggcttcgtggacggctaccgttcagcagctatgctatcgagcgtgggtgacgacgcggccccgtggacgagggcttggagtggagtgggaggtatcgactccttatcgtttaggtatacgacaaacgtacgacacgaagtaacgttcgagggcagacgtcagtacttaaccgacgaacaacaccgacgacaccaacncgtactactagnggtagacgngacgcgacgcgtagacgtntcggtaggaccggcgtacggtacgttgttaacgttcggaggttacgcggtaaggtacgtaagtaccggtaaggttacggtttagtttacttcgggttcccgttaaccgggg

SEQ ID NO: 173327 - DNA, 823 bp, Homo sapiens
  misc_feature: GYAE6OF01DL4K1.48.79.H02.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (652)..(652): a, c, t, g, unknown or other
  misc_feature (652)..(652): n is a, c, g, or t
tcagagtatacatacacgaccggtgctcgatttagtgtcacacgaagggaaaggggatcacataacaaccacacttcctcctactaaagaacgcccctgggagcacagctcatcaccagtggactggacctggacgttcctctttgtggtggcaggcagctaacgaggtcgtaccacgtcccagggtcncagcgttggngcgaggtcgtggggctaggaggtagaagacgccgtgggtcctggtagaacggtcctaccgtgacgtaaggtcttcggtaggacgtcctaccttcgacggacacgtacttagtcgtacgtaacgtcgacggtccggttagggggtaccgaccgaaccggacccgggtccccgtagggaacgtacgggtcgttacggaggttagggaaggttgggggacggtaacttaccgtaacgtttacccgtagttttaccggtttaggtaaacgtaaccggtaaacctaaaaccggttaccggaacccgtaaggtaaacggtttaacggttacccggtaaggggaacttaacgggtaacgtacccggtaaccgtaacggttaaccccgggaacggtaaaacctaaaccggtccaaacgggacaccgtaaccgacgtaaccctaaggttacggagggttacncgtaggaacgccgaaacgtcggtaacgtacgtaccgtacggaacggaccggtaccgtaccgggttacgttacgttaaacgttcggtcggttaaggacggtaacgggatttaacggacgtaacgggtttagttaaggttttacctttaacgtcccggggtttaaacccgggg

SEQ ID NO: 173328 - DNA, 842 bp, Homo sapiens
  misc_feature: GYAE6OF01EV158.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtctccacgtcccaggtgcagctggtgcagtcgtgggctggaggtgaagacgccgtcgggtcctcggtagaacggtctccgtgactaacggtcttgtgggacgcctaccttcgagccgtagtaccttagtcgtacttacgtcctaaggtccggttgggggtacgacccggaaccgtacccgggttacccccggtagggaaaccggtaacggggttccggtttagggaagggttacgggtaagggttacgggggacggtaacgtacccgtaccgttaccccgtttaagtttcggtttaacggtaaacgtaacccggtaaacctaaaacccgtacggtaaccgtaacggtaaacggtaaaccggttccggaacgggtaccgtaaggtaaccggtacgtaaacccggttacggtaaccccggaacggtaaaccctaaacggtaccgaaccgtacgaaccgaacccgtacgtaaccccgtaacgtacgggtaacgggacgttaccggaacggaccgtaaccgacggtaccctaagggtaacgtcggtacgtaacggggaaccgtacccgggtaaccggttacccggtttagtaacgtttacgggtgtacggggagtaaagggattacccggttaaggtaaggggttacgtttaaggttttacgttccggttcccgggttaaaccggg

SEQ ID NO: 173329 - DNA, 715 bp, Homo sapiens
  misc_feature: GYAE6OF01C9YTQ.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctcttgtggtggcagcagctacaggtgtccagtcccaggtgcagctggtgcagtcgtggggctgaggtgaagaagcctgggtcctcggtgaaggtctcctgcaaggtcttcgtggacggctaacccttcagtcagtctatgctatcagtcgtgggtgaccgacgacggccccgtaggaccgaagggtcttggacggtagggaggtaggggagggtactcgtacgttacccttagttcgtttaggtacgtaacgacctaaaacgttaccgactaaccgtaaggtaacgttccggagggtaccgaacggtacgtaccgtaacccggtaaccgtttaaccccggggaccggtaaacctaaaccgtcccgaacggaacgacccaacgacgacccctaacgagtacgggaagcgtacggacgaccgtaaggtaccccgtagggactacgttacgacgggtaacgggacccgtaaccgggttccggtaacggtttagttacccgtgggtacggacggtaacgtaacggtaggttaccgaagggtttacggttagggttttaactccggtttccggtttaaccgggg

SEQ ID NO: 173330 - DNA, 786 bp, Homo sapiens
  misc_feature: GYAE6OF01BGTZB.48.79.H02.1.454.CMB.1.raw
  modified_base (274)..(274): a, c, t, g, unknown or other
  misc_feature (274)..(274): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctccgtgcaaggcttctggaggccaccttcagtcagctatgctancagcgtgggtcgcgacgtacggccccgtaggaaccgaagggtccttgggaggtgggaacgttggggaagggtactacgtacgtcccgttagtttccgtttggtaacttaacgactaaaaccgttacgacgaacgtaaacggtaaccggtttaccgaacggggtacctaacgggtaacggtacctaaacgggttaaccgtttaaccccgggacggggtaaaaccctaaaaacgttaccccgaaccggtaaaccggacccgtaaccgtaaccgggtaccccttaaccgaacggtttcggggaaccggttacggttacgggaaccggtacctaacgggttaccccggtaggtaaaccggtaccttaccgggtacgggtaaaccgggtacccggttaaccgggtacccggttaggttaaccgttttacggacgggttacgggacggtaaggtaacgtacttacggtaaacggttagggtttaggtttaacgttacggttcccggtttaacccgggg

SEQ ID NO: 173331 - DNA, 608 bp, Homo sapiens
  misc_feature: GYAE6OF01CWNO6.48.79.H02.1.454.CMB.1.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
  modified_base (454)..(454): a, c, t, g, unknown or other
  misc_feature (454)..(454): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagagcctgggtcctcggtgaaggtctcctgctaaggtcttcgtggaggcctaccttcgagccagctatncttancagtcgtgggtcgcggaccgcggcccgtggaaccgagggtctaggnggtggagtgggaggtactctacgtccttagttccgttggtatacgactaacgtacgacacgacgtaacgtcgacggcagctcaacgtactaccggcgaactaactccgaagcacgacgacgaccctanacgtgacgcgtagacgtccgaacgtccgttagggacttacgtcgtaacgggacgtaaccggccggttactaggttcgttaccggacgggttagacggagtacggtactacggtaagttccggtttaagtttaaccgtcggttcccgttacgggg

SEQ ID NO: 173332 - DNA, 618 bp, Homo sapiens
  misc_feature: GYAE6OF01C74DR.48.79.H02.1.454.CMB.1.raw
  modified_base (440)..(440): a, c, t, g, unknown or other
  misc_feature (440)..(440): n is a, c, g, or t
  modified_base (514)..(514): a, c, t, g, unknown or other
  misc_feature (514)..(514): n is a, c, g, or t
  modified_base (527)..(527): a, c, t, g, unknown or other
  misc_feature (527)..(527): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
  modified_base (578)..(578): a, c, t, g, unknown or other
  misc_feature (578)..(578): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttccttctttggtggtggcagcagctacaggtgtccacgtcccgaggtgcagctggtgctagtcgtggggctggaggtagaaggaagccgtgggtcctcgggtgaaggtcctccgtgactaggtcttcgtggacggctaccttcgagcagtctatgctatcagtcgtgggtgccgacgaccggtccccgtaggacgaagggtcttagggacggtgggacggtaggggaggtactccgtagttcccgtttagttcgtttaggtaactacgtaacgtaaacgtcgacaacgtagacgtcggaggtcgagntacgacgtactaccggacgtaacaacgtaccgagacgaccacacgccgtaacgcgaggtacacgtagacgacgngccgtagagtacncgtggacgacgtaccgggcgttagtagttacgngtacggngtaacgaagtntagtaaggttacgtttaggttaacttggttccgtaacggg

SEQ ID NO: 173333 - DNA, 604 bp, Homo sapiens
  misc_feature: GYAE6OF01D6G5L.48.79.H02.1.454.CMB.1.raw
  modified_base (199)..(199): a, c, t, g, unknown or other
  misc_feature (199)..(199): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctggggctgnggtgaagaagcctgggtcctcggtgaaggtctcctgcaaggcttcgtggaggcaccttcagcagctatgctatcagtcgtgggtgcgacgacgggccccgtggacgaagggcgttggagtgggagtggggaggtatcgactccttagttcgtttaggtagtaacgaccgtaaacgtaccgacacgaaggtaacgttaccgagggtacgagtacgtcgaaccgtacgtaccggacgaaccaaacgtccgaacgacgccaacacgtccctaacgagtcggagcgtaggacgacgacgacccgtagagtactcgtaggacggaccggaccggtcgtacgttagttacgtcggtggacggagacggtagtacgtaggtagtttaggtttacttacgtccggttaccggg

SEQ ID NO: 173334 - DNA, 912 bp, Homo sapiens
  misc_feature: GYAE6OF01BZITT.48.79.H02.1.454.CMB.1.raw
  modified_base (245)..(245): a, c, t, g, unknown or other
  misc_feature (245)..(245): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagcctgggtcctggtgaaggtctcctgcaaggcttcgnggacggcaccttcagcagctatgctatcagtcgtggggtcgacggaccgaccgggtcccccgtagggaaccgaacggggtcctttagggaaggtttcgggaaggttaggggggaacggggtaacttaccgaaccgttaccccctttaagtttccggttttagggtaaacttaacggaacccgtaaaaaccgttaaccggtaccgtaaaccgtaacgggttaaaaccggtttacccggaaagggggtacccgtaagggtaccggttaacccgaaccgggttaaaccgtttaaccccggggaacccgggtaaaacccgttaaaaacccggttaccccggtaaaaccgggaaacggtaacccccgtaaacccggaaacccggtaaccccgtttaaaccgaacggtttaccggggaacggttaccggtacggaacccggaccgtaaccggtaccccgttaagggtaaccgttaaccgttacccggtaagggtaaacccggtaaccgggtaaaccccggggttaccggtttaacggttaaaaccggttttccggttaacggggtaccggttaacccgggaaagggttaacggtaaacggtttccgtaaaggggtttaacggttttaacgggttttaacgttttaaacccgttccccgggtttaacccggggg

SEQ ID NO: 173335 - DNA, 797 bp, Homo sapiens
  misc_feature: GYAE6OF01EVSJ2.48.79.H02.1.454.CMB.1.raw
  modified_base (770)..(770): a, c, t, g, unknown or other
  misc_feature (770)..(770): n is a, c, g, or t
tcagagtatacatacacgaccggtgctcgatttagtgtcacacgaagggaaaggggatcacataacaaccacattcctcctctaaagaagccccgtgggagcacagctcatcaccatggactggacctggaggttcctctttggtggtggcagcagctaacgaggtcgtcccgacgtcccgaggtgcagtccgtgggtgcgtacggtcggtcggggcttgggaagggttagaaacggaacggtcccggttcggggttcccgttacggggtaaggtaacggggttcccttccgtaggtaccggaaaggtccgtttacgggtacggggacggccccgttaccgttaccgtaaggtaccgacggtaccttaagtcgacttaactcgtacggtcggttacggggtcgaccggtaccggaccggtccccggtagggaaccggtaacggggtcctttgggaggtcggagggtggggacggtagttacctacgtacctttaacggttttcgttaaggtacgtaacggtactaacgaccgtacaacgtacgtaccggtacggtagacgtcgtacgtacgtaacgtacggtaccggacaaacgtactacccgaagaccgtaccgactacgtaccgtaacgtccggaaggtacgtcccgtagaccgacgtaccggtagtacggtacgtaaggtccgaagggacccgtaaccggtacgggtaccgttagttacctacgggtagtaggtacggacgagttaccgaaggttaggttacggttntttaacgttcggtccggtttaaccggg

SEQ ID NO: 173336 - DNA, 818 bp, Homo sapiens
  misc_feature: GYAE6OF01CJNZV.48.79.H02.1.454.CMB.1.raw
  modified_base (260)..(260): a, c, t, g, unknown or other
  misc_feature (260)..(260): n is a, c, g, or t
  modified_base (748)..(748): a, c, t, g, unknown or other
  misc_feature (748)..(748): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtgcagcagctacaggtgtccagtcccgaggtgcagtcctgggtgcagtcgtggggctggacggtgaagacgtccgtagggtcctgggtgtaacggtctccgtgcaaggtctttcgnggacgcctaccttacgagcagtctagtcgactacgtcgagtcgtgggtcgacgaccgtccggtaccccgtagggaaccggagggttaccgttagggaggtagggtaaggtcggggtacggtacgtacccgtaccttacccgttgttttaccggttaaggttacgtaaccgaaccgtaaaccgttccggaacgtaacgtaaacgggttaaccgttaacggcgggaacgtacgtaaccggtaccgtaacgggtaaccttacccgggaaccgtaaacgttaaaccgtacccggaacggaaccgtacccgtaaccgtaaccggtaacccttaaccgagggtttaaccgggaacgttacccggtacggaacggttaaccggaccgttaaccgggtacgttaaggtaccgttaccggggaaccgttaccgggaaccccggttagggttcccgttaaggtttaaaccggttacgttacgggaacggttaacgggngtaaccgtaggtttacggtaacgggtttggtttatttaacccggtttccgtttaccgggtttaacccggg

SEQ ID NO: 173337 - DNA, 599 bp, Homo sapiens
  misc_feature: GYAE6OF01AMZ83.48.79.H02.1.454.CMB.1.raw
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
  modified_base (553)..(553): a, c, t, g, unknown or other
  misc_feature (553)..(553): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctggaggtggaaagaacgccgtgggtccgttcggtggaaggttcctccgtgaccgaacggccgtttcgtgggacgcctaccttcgagcagctagtgctatcacgtcgtgggtgccgaccgacggtccccgtaggaaccgaacgggtcttggaggtggaggngggaggtactcgatcccttagttcgttgtatacgactaaacgtcgacanagacgttcgacgganagagtcgacgtacttaccggacaacgaactaccgacganacgaacacgaccctagacnggacgcgtagacgccacggaccgtcgaagcctacgtaggaccgacgacggtccgttagtcgttacggtgtcgngtacgtagacgtagaaggttggttagtttacttgtccgttaccggg

SEQ ID NO: 173338 - DNA, 753 bp, Homo sapiens
  misc_feature: GYAE6OF01EZODV.48.79.H02.1.454.CMB.1.raw
  modified_base (254)..(254): a, c, t, g, unknown or other
  misc_feature (254)..(254): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctgggaggttcctctttggtggtggcagcagctacgaggtcgtccagtcccaggtgcagcgtggtgcagtcgtgggctggaggtgaagacgccgtgggtcctggtgagtctccgtgcgtaggtcttcgnggacgcctaccgtcagcagctagtgactatcgaggcgtcgggtcgcgacgtaccggcccgtaggacgtaaggtctgggagtggaggtgggagatcctaacgttcctatttcgttagtaatacgacctaaacgtcgacaacggtaagtaaccggttccggaaggtccaaggtaccgtacgaacgtaaccgtacccggacggtaaacccaaacgtcccgaaacggtacgaccgtaaccgacgtacccgtaacgtaaggtgggaaccgttcgtacggaaccggtaccaacgggtaccccgtagggaaccgtttacgtccccgggtaagggtaacccgggtaaaccgtaccccgggggtttaacggttttagttaaacccgtttaccgggttacggggtaaccgacggggttaaacggaaacggttacgttaacggtttaaagggggttaagttttaccggtttttaaaacggtttcccgttcccgggggttttaaacccggg

SEQ ID NO: 173339 - DNA, 604 bp, Homo sapiens
  misc_feature: GYAE6OF01D9I2D.48.79.H02.1.454.CMB.1.raw
  modified_base (526)..(526): a, c, t, g, unknown or other
  misc_feature (526)..(526): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctggaggtgaagagcctgggtcctcggtgaggtctcctgacaaggcttcgtggaggccaccttcagcagctatgctatcgagcgtgggtcgacgacgaccggccccgtagggacgagggtcgttggaggtgggagtgggaggactcactcctgttcgtttggactagaaccaaacgtacgacaacagtacgtacgagggcaggacgtaccgaacgtacgttaccggacggaaacaacgtaccgaacggtaacacccaacgacgtaccctaacgtagtacggcgtacgtaggacacgtacggacgtagtagtattcgacggaaggtacccncgggtcgttagttattcggtacgtaggacggagagtacgtacgtaggttacgtaggtttacttacgtcggttaaccgg

SEQ ID NO: 173340 - DNA, 799 bp, Homo sapiens
  misc_feature: GYAE6OF01CWZ5D.48.79.H02.1.454.CMB.1.raw
  modified_base (270)..(270): a, c, t, g, unknown or other
  misc_feature (270)..(270): n is a, c, g, or t
  modified_base (643)..(643): a, c, t, g, unknown or other
  misc_feature (643)..(643): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggagttcctctttgtggtgcagcagctacaggtcgtccagtcccgaggtgcagcgtggtgcagtcgtggggctgaggtagaagaacgtccgtcgggttcccgtcgggtagaacggtcctccgtagtacgaaggtcctttcggngggaccggtcctacccgtttcgacgaccgagtccttaagtcggtaccttaactcgtacgtcggtggggttacggacccgaccggacccggtccccggtaacggggaaccggtaacggggttcgtttgggtacgggtagggtagggtagggggacggtacgtaccgtacccgttacccgtttagttttccgttttaacgggttaacgtaacgtaaacccgttaaaaccgtaccgaaccgtaacggtaaacggttaaccgttaccgggacgggtaaccgaggttaccgtaacccgtaaccgtaaccggttacccggaacggtaaacctaaccccgtacgaaccgacgacccgtaaccaacccggtacctaaacgngggttacggacgtacggtacggaccgaccggtacgtaaccggcggtaagtccgttaggaacgaccggaaccgtccggtaccgttgttactacggtcgtacgacggtggactacgtcggtacgtttaggttagtttacgtccgttacggttaccggg

SEQ ID NO: 173341 - DNA, 669 bp, Homo sapiens
  misc_feature: GYAE6OF01A4Z2H.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtgcagcagctacaggtgtccagtcccaggtgcagctggtgcagtcgtggggctgaggtgaagaagccgtgggtcctcggtgaaggtctctgcaaggtcttcgtggaggcaccttcacgctagctatcgcttatcaggcgtcgggtgaccggacgaccggccccgtggaaccgtaaggtcgttaggaggttgggaaggttgggggaacgggtattaccgtaacttccccgtaagtttcgtttagggtaactacgtaacaaaccgtcgacaacgtagtaacgttaccgagggtacacggtacgtaccgtaacggtacttaaccggacggtaacaacgtaccgaacgacgtaccacgaaccgtccctaacgacgtagggaacgtcgtagaacggtccgactccggtaagacgtactacgtacgggacggtaccgcggtaccgttagtacgttacggtggtgaccgggatacgggtactacggtaacgttacgggtttagtttaacttccggtcggtttaacccgggg

SEQ ID NO: 173342 - DNA, 727 bp, Homo sapiens
  misc_feature: GYAE6OF01EBSCC.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagtctggtgcagtcgtgggctggaggtgaagagccgtgggtcctcggtgagtctcgtgcagtctgtggcgctaccttgagcagtctagtcgactactcacgtcggtgggtcgaccggacgaccgggtaccccgtagggaacggtacggggtcttagggacggtaggtagggtggggtagggtacttaccggtaccttccgttacgtttacgttagggtaactaacgacgtaaaccgtacgactaacgtacgtaacggtaccggtaggacgtagtacgttacgaaccgtacgtacccggaacgtaaccgtaaacgtcccgaacggaacgtacccaacgtaccgcctaacgtcggtaaccggatacggtacgtacggtaacctaccgggtacgtacggtaagttcctacggtacgggaaccgtaccgggtaacccggtccggttttagaacccggttttggtacgggtacggaaacggtacgtacggaacgttaacgggtaacggtttacggttttaaggtttaacccttgggttccccggttaaacgggg

SEQ ID NO: 173343 - DNA, 682 bp, Homo sapiens
  misc_feature: GYAE6OF01CMROL.48.79.H02.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagagtatacatacacgaccggtgctcgatttagtgtcacacgaagggaaaggggatcacataacaaccacattccctcctctaaagaagcccctgggagcacagctcatcaccatggactggacctggaggttcctctttgtggtggcagcagctacaggtgtccagtcccaggtgcagctggtgcagtcgtgggctggaggtagaagagccgtgggtcctcggtgaacggtctaccgtgacgtaaggtcttacgtggacggcctaccttcgagcagtacctagtcgcttanccgtagcgtggggtcnccggacggaccggtcccgtagggaaccgtaagggtcttacggaggttagggaggtggggtacgggataccgtacgttacccgtttagtttccgtttaggtaactaggtaacctaaacgtacgacaacgtacgtaagtccggaggtacagacgtaccgaacgtaccgtaccgacgaaaccaacgtcccgaacgaacgtccaaccgtacgtacccttaagagtacggagtcgacgtagaccacggtccgtaagcgtacgttcgaacgggaccggacgccgggttaccgtagtttaagtacgtcggtacggtacggtagacgttagtacgggtattacgggttagtttcgtttaacggtcccgtttaacccgggg

SEQ ID NO: 173344 - DNA, 633 bp, Homo sapiens
  misc_feature: GYAE6OF01CODCH.48.79.H02.1.454.CMB.1.raw
tcagagtatacatacacgaccggtgctcgatttagtgtcacacgaagggaaaggggatcacataacaaccacattcctcctctaaagaacgcccctgggagcacagctcatcaccatggactggacctggaggttcctctttgtggtggcagcagctacgaggtgtccagtcccaggtgcagctggtgcagtcgtggggctggaggtgaagaagcctgggtcctcggtgagtctcgtgcaagctgtggacggctaccttcagcagtctatgactatcgagtcgtgggtcgcgaccgacggccccgtaggaccgaagggtccgttaggaggtgggagtaggggagggtactacgtacgtcccttagttaccgtttaggtaagtacgaactaacgtacgactaactagtaacgttccgagggcaagacgtaccaacgacgttaacccggagtaactaaccgtcaacggaacgccaacgcgacctacgaggtacggacgacgttagcgtacacggtaccgtagacgtacgtacgtaggacggtaccgaccgggtacgttacgttgttacgtcggtaggacggtaacgagtaacgtaggtacggttaggttaggtttaacttggtccggttaccggg

SEQ ID NO: 173345 - DNA, 867 bp, Homo sapiens
  misc_feature: GYAE6OF01E5MSI.48.79.H02.1.454.CMB.1.raw
  modified_base (250)..(250): a, c, t, g, unknown or other
  misc_feature (250)..(250): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagccgtggtcctcggtgaacggtctcctgacacggtcttcgnggacggcctaccgttcagcaggctagtcgctatcgaggtcgtcggggtcgacgtaccgaccggtccccgtaaggggaaccgtaacgggggtctttacgggaggttacgggtaagggtaggggggtaacgggtacttaccgtaaccgtttaccccgttaagttttaccgtttacggggttaactaaccggtaaacctaaaacccgttaaccggaccgtaaaccgtaaacgggttaaaccggtttaccccggaaacggggtacgaacgggtaacgggtacccaaaccgggttaacccggttaacccccgggaacgggtaaaacccctaaaaaggttacccccgtaaagggtaacccggacccaaacccgtaaccggtacccgttaaaccgtaacgggttagggaacccggttacgtaacgggaaccgtcccggtaacgtacccgggtagtaacggtaccgtggtaacgggaaccgggaacccggtaccgggttaccggtttacggttaacgttcgggtacgggtaacgggaaccggtaaggttaacggaaccgttaacgggtagggtttaaccggttttaggtttacgtttaaacccgttccgggtttaaacccggggg

SEQ ID NO: 173346 - DNA, 639 bp, Homo sapiens
  misc_feature: GYAE6OF01E3NDM.48.79.H02.1.454.CMB.1.raw
  modified_base (510)..(510): a, c, t, g, unknown or other
  misc_feature (510)..(510): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttggtggtggcagcagctacaggtgtccagtcccaggtgcagctggtgcagtcgtggggctgaggtgaagaagcctgggtcctcgggtgaaggttcctccgtgcaacggcttacgtggacggccaccttcagcagctagtgctatcagcggtggtcgcgacgtcggccccgtaggacgtagggtcttgggaggtcgggagtcggggtaggatccgaacctcccgttaagttccgtttagggtaattacgaacgtaaactaccgactaacgacgtaacggttaccgagggacctaggtaccgacgtaacgtaacgttacccggtacggaaccgaaactccgaaccggtacgacccgaacaccgtacccgtanaacgtcggacgcgtacgacggactaccgcgtagacgtatcgacggacgacgtaccgtcgttagtacgttacgtcgtaggacggagagagtaggtagttaggttaaggttacttgttccggttaaccggg

SEQ ID NO: 173347 - DNA, 898 bp, Homo sapiens
  misc_feature: GYAE6OF01EC2CX.48.79.H02.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcacacgaagggaaagggatcacataacaaccacattccctcctctaaagaagccccctgggagcacagctcatcaccatggactggacctggacggttcctctttggtggtggcagcagctacaggtcgtccagtcccaggtgcagctggtgctagtcgtcgggntaggaggtgaagacgtccgtgggtccgtacggtagtacggtcctccgtagacgtaggtacttcggtacggggaccgtacccttaccttacggacgtcgaccgttacgttagtcggtacttacgtccgaggtcggttagggtaccggaccgacccgggacccggtacccgggtacggtaaaccgggttacgggtacggttagggtagggttagggtaaggggttagggggaaacggttcctacgttaacccgttaccgttacgtttttcgggttaagttaaccgtaacgaaaccgtttaaaacccgtccggtaaaccgtaacgggtaaacgggtttacccggtaaccggggtacggtaacggtaaccgggtaccgtaccggttaaccggtaacccggtaccccgggaacggttaaaccaacccgggtaccgaacggcgttaacccgaaccgtacccttacgactacgggtaggaaccgtcggaacggtaccgacgtacccggttaaggtccggtaagttcggaacggttaaccgggaaccggtacccgtaccggggttttaccggtaaacggtttaaaccccggtgggtttaacggtaccgggtaagtaccgggttaacggttacgggtaacgggtaaggtttaccgggttttaacgttttactttacccggggttacgggtttaaacccgggggg

SEQ ID NO: 173348 - DNA, 705 bp, Homo sapiens
  misc_feature: GYAE6OF01EBVO3.48.79.H02.1.454.CMB.1.raw
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (528)..(528): a, c, t, g, unknown or other
  misc_feature (528)..(528): n is a, c, g, or t
  modified_base (553)..(553): a, c, t, g, unknown or other
  misc_feature (553)..(553): n is a, c, g, or t
tcagagtatacatacacgaccggtgctcgatttagtgtcacacgaagggaagggatcacataacaaccacattcctcctctaaagaagcccctgggagcacagctcatcaccatggactggacctggagttcctctttgtggtgcagcagctacaggtcgtccacgtcccaggtnacgagtcgtggtgcaggtccgngggggctggaggtaggaagtacggccgttggggtcctagggtacgaacggttcctccgtggacaacggtctttcggtagggacggcctaccttagacggtcaggtctagtcncgtancgacgtcgtgggtcacggcggaccggccgtacgggacgtaacgggtctggaggttacgggtaggtacggggagggtctaccgttacgttcccgttaatttcggtttacggattaaccggactaaaccggcgactaacgtaacgtacggttccgaagggtacacggtacgttacgacggtaaccgttacgggaacgtaactaaaccgccggtaanaccggtacaacgtacctacggaacnggaccgtagcgtagagaccgtacgaccgggtatacggacttacggacggtacgggtaccgtacggttcggttaattaaccggttcgcggtagcggtagacggtagttacgagggtttacgtagttttaacccgttgtaccgggtttaaccgg

SEQ ID NO: 173349 - DNA, 580 bp, Homo sapiens
  misc_feature: GYAE6OF01EU4ED.48.79.H02.1.454.CMB.1.raw
  modified_base (241)..(241): a, c, t, g, unknown or other
  misc_feature (241)..(241): n is a, c, g, or t
  modified_base (334)..(334): a, c, t, g, unknown or other
  misc_feature (334)..(334): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctggaggtgaagagctgggtcctggtgagtctcctgcaggcttcgnggaggctaccttcagcagtctagtcgctatcgagcgtggggtcgccgacgcggtccccgtaggacgagggtctggagtggagtgggagtactntactcctagttcgttagtatacgactaacgtcgacacgtagaacgttcgaggcagacgtacacgtactaccgacgtacaactccganacgacacgacgcctaacnggtaggacgtcgtagacgctacgtctaggtacgtattaccggaggaccggtaccgtccgggtacgttagtaacgttccgtggttacggacggtaggacgtagacgtaggttaggttagtttacgttagtccgttaaccggg

SEQ ID NO: 173350 - DNA, 659 bp, Homo sapiens
  misc_feature: GYAE6OF01ELKJW.48.79.H02.1.454.CMB.1.raw
tcagagtatacatacacgaccggtgctcgatttagtgtcacacgaagggaaaggggatcacataacaaccacattccctcctctaaagaagccccctgggagcacagctcatcaccatggactggacctggagttcctctttgtggtggcagcagctacaggtgtccacgtcccaggtgcgagctggtgcagtcgtgggctggaggtgaagagccgtggtcctcggtgaacgtcctccgtgaccgaaggtctttcgtagggacgcctaccttacgagtccgagtctagtcgacgtatcgagcgtggtcgcgacgacggcccgtggacgaggtctggagtggagtgggaggatcgactccttatcgtttaggtactacgacaaacgtccgacacgtaagtaacgtaccgaggacgaagtcgtacgaacctacggttaacccgacgtaaacctaaacgtacccgaagacgtccgaacaccggtacccacgtagtcggaagccgtaggacaccgacgccgtagacgtacgtcgtacgggacgtaccggtaccggtacgttacgtttaacgttacggtcggtacggacggtacggaagaccgttaaccggtaagttaacgggtttaccgttttaacgttttaacgtcccgggtttaaccgggg

SEQ ID NO: 173351 - DNA, 787 bp, Homo sapiens
  misc_feature: GYAE6OF01DOHIH.48.79.H02.1.454.CMB.1.raw
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttccttctttgtggtggcagcagctanaggtntccagtcccaggtgcagtctggtgctaggtcgtggggtctggaggtagaagacgtccgtggggtcctggtgacgttcctacgtgacgtaggtcttgaggcgctactcagcagctntgactancgtagtggtcgggtcncgaccggaccggtccgtagggtacgtacgggtcgttaggnggtcgggtaggtaggggtaagtacctacgtaccgttccgttagtttaccggtttaggtactaacggaacctaacgtaaccggaactaacggtaacgttaaccgttaccggaacggtacgacgggtaacgttacccgtaaaccggtaacccggttacccggaacgtaaacgtttaaaacccggcccgaaacggtacgaccccgaaccggtaccgttacccgtttaagaacgggtttggggaacctttacccgagggtaaccggtaaccctaccgggtattaacggggtaaccgtttaccggccgggttaagggaaccggttaccccggagggtttaacccgttagtttaccggtacgggtcggtacggaaaggttcaaacgggtccgttaaaggttacggggtttacgtttacggtttaaccttcggtcccgggtttaaacggggg

SEQ ID NO: 173352 - DNA, 776 bp, Homo sapiens
  misc_feature: GYAE6OF01BFJBG.48.79.H02.1.454.CMB.1.raw
tcagagtatacatacacgaccggtgctcgatttagtgtcacacgaagggaaagggggatcacataacaaccacattcctcctctaaagaagcccctgggagcacagctcatcaccatggactggacctggacggttcctctttgtggtggcagcagctacgaggtgtccagtcccaggtgcagcgtggtgcagtcgtgggctggaggtggaagacggtccgtgggtccgtcggtagtacggtctccgtagcgaggtcttcgtacgggacggtccaccgttcgacgcgtacgtcgtatcggtctaacgtcaggtacgttggggtacgccggtaccgaaccggtccccggaggacggtaacggggtcttcgggaaggtgggtgtagggggaacggtacgtcctacgttacccgttacgtttcgtttacgggtaacttacggtaacccaaacgttaccggaccgacgaaccgggttaacgttccggaagggtacgaacggttaacggttccgaacggttacccggtaacccgacggtaacccgtaacacccgtaacggaccaccgaccgaacgctaaacgtccggtaggaaccgtggaagaccgggtcgaacccgttcgggacgtaccgggtaactcgggtaacgggaacggtaccggtacccgggtacgttacgttaaccggttacggtcgggtacgggtacggtagaaccggtagttaaccccggtaggttaccgggtttaagttaccgtttaaaccggttccgggtttaaccgggg

SEQ ID NO: 173353 - DNA, 764 bp, Homo sapiens
  misc_feature: GYAE6OF01A359R.48.79.H02.1.454.CMB.1.raw
  modified_base (164)..(164): a, c, t, g, unknown or other
  misc_feature (164)..(164): n is a, c, g, or t
  modified_base (616)..(616): a, c, t, g, unknown or other
  misc_feature (616)..(616): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggacggttcctctttgtggtggcagcagctacaggtntccagtcccaggtgcagctggtgcagtcgtggggctggaggtagaagtacgccgtgggtcctcgggtggtaacggttcctcctggaccgtaagggtcctttcggtacgggacggtccctacccgttcgacggtcacggtcttagttcggtacctacgttcgacggtcgttggggtaccggaccggaaccggtaccggtccccggtaaggaacccgggtaacggggttccgttttagggaacgggttagggtagggttacgggggaacgggtacttaacgtacccgtttacccgttagtttccggtttaaggtacttaacggaacctaaacgtccgaacgtaaacgtacggtaaccgttacggacggacgaaggtaccgtacgaacgtaaccgtaccggaacgtaactaaccgtaccgaacgacgaccgacacggtaccaacgtacgcggacncgtaacgacgacgtcgacgtagtatcgtacgtaggacccgaggaccccggttagttaccggttacgtttcggtccgtaggggtacgaacgttacgagtacgggttaacggttacggttaggttttaacgtcggttccggttaaccggg

SEQ ID NO: 173354 - DNA, 807 bp, Homo sapiens
  misc_feature: GYAE6OF01AQABX.48.79.H02.1.454.CMB.1.raw
  modified_base (159)..(159): a, c, t, g, unknown or other
  misc_feature (159)..(159): n is a, c, g, or t
tcagagtatacatacacgaccggtgctcgatttagtgtcacacgaagggaaaggggatcacataacaaccacattcctcctctaaagaagcccctgggagcacagctcatcaccatgactggacctggaggttcctctttgtggtggcagcagctacgngggtcgtccacggtcccgaggtgacgagccgtggtcgcgtaggttcggtcgggggctagggaggttaggaacggtaacggccgttcggggtccgttccggggtaggtaccggttcctccggtacggacgtacgggtcttcggtacggggaccggtctaccgttcgaacgtcaacgtcttacgtctacctagtacctacggtcggttggaccggtccggaccggtaccgggcccggtaagggacccggttaagggtccgtgggtaagggtcgggagggttacggggaggttactccgtaaccgtttaccgttagtttcgttacggtaacttacggaacaccgttacgaactacggaacgttacggtaaccgagggctacggttacaccggtacgtaacgtaccccggaagaacccgttacaaccggacggaacgacctaacgtaccgtaaccgtaccggtagtaccgggacgtacccgtaacgggaacgttcccggaacgttcgaaccgttaaggacccgtttagggacggtaaccggtaacgtccgggtaaacggtttcgaccggtttacgggacaggaacgttaacggtcgtaaggtacggttcggtttaacgttacggtaccgtttcgggttaccgggtaaacggg

SEQ ID NO: 173355 - DNA, 612 bp, Homo sapiens
  misc_feature: GYAE6OF01BKASZ.48.79.H02.1.454.CMB.1.raw
  modified_base (101)..(101): a, c, t, g, unknown or other
  misc_feature (101)..(101): n is a, c, g, or t
  modified_base (270)..(270): a, c, t, g, unknown or other
  misc_feature (270)..(270): n is a, c, g, or t
  modified_base (437)..(437): a, c, t, g, unknown or other
  misc_feature (437)..(437): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (563)..(563): a, c, t, g, unknown or other
  misc_feature (563)..(563): n is a, c, g, or t
  modified_base (576)..(576): a, c, t, g, unknown or other
  misc_feature (576)..(576): n is a, c, g, or t
tcagagtatacatacacgaccggtgctcgatttagtgtcacacgaagggaaaggggatcacataacaaccacattcctcctctaaagaacgcccctgggancacagctcatcaccatggactggacctggacgttcctctttgtggtggcagcagctacaggtcgtcccagtcccgaggtgccagcgtggtgctagtcgtggggctggaggtgaagacgtccgtgggtccgtggtagaacggtcctccgtggaccgtaaggtctttcggngggacggtacctaacccgtttcgaacggcgtaacggtaccgttaagttccggaccttagttacccgaggtccgttggggtacgaccgtacggaccggtccccgtaggaccgtagggtcttggaggttggacgtggggaggtatcgtacgttcctattcgttaggtanacgacaacgtcatacgagtacgtcgaggcagatcagtntccgaganancgagncancgnagngtgacgtnacgatcgagtcgaggtactgtcggaacggaacgtccgtacgtccgttattacgtgnggtcgactaaggnttacgactaggttcgttagttatccgtcggtaacgg

SEQ ID NO: 173356 - DNA, 894 bp, Homo sapiens
  misc_feature: GYAE6OF01DOT12.48.79.H02.1.454.CMB.1.raw
  modified_base (212)..(212): a, c, t, g, unknown or other
  misc_feature (212)..(212): n is a, c, g, or t
tcagagtatacatacacgaccggtgctcgatttagtgtcacacgaagggaaaggggatcacataacaaccacattcctcctactaaagaagcccctgggagcacagctcatcaccatggactggacctggaggttcctcttggtggtggcagcagctacgaggtctccagtcccgaggtgcagctggtcgcagttcgtcgggactggaaggngaaggacgtccgttcgggtccttcgggtaggtaacggttcctccgtgacgtaggtcttcggagggacgtccgtaccttcgacgcgtacggtactagttccgattacgtaccgtacggtcggttcggggttaccggaaccggttaccggaccggggacccccggttaaggggtaccgggtaaacggggtccgttaggggtaggtacgggtaggttacgggggaagtaccgttacgttaccgttcccgttaacgtttacggtttaacgggttaacgtaacggtaaacccgaaacggtaacccgtaaccgtaaacgtaaggttaacccgggtaaccggaacgggtaaccggtaacgttaccgggtaaacccggttaaccggtaaacccgggttaaccccggaaccgggttaaacccgaaaccgttaccccggaaacggtaccgtaacccgtaaccgtaccgtaaccccgtaacgggtaacggttacggtaccggaaccgtacggacgtaaccgacggtaacccggtagaacggtacgttaccggaacggtaccggtaaccggccgggttacggttaccggttacgttacgggtttagaccgggtaccgttaacgaacggttactaacggttacggggtttaaccgttaggttaaccgtttaccgggttccggttaaacccggggg

SEQ ID NO: 173357 - DNA, 785 bp, Homo sapiens
  misc_feature: GYAE6OF01CL3U7.48.79.H02.1.454.CMB.1.raw
  modified_base (631)..(631): a, c, t, g, unknown or other
  misc_feature (631)..(631): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggacggttcctctttgtggtggcagcagctacaggtgtccagtcccaggtgcagcgtggtgctagtcgtggggctggaggtgaagacgccgtggggtcctgggtgaaggtctacctggacgtaaggctttacggtgggaacgggtcctacccgttttacgaggtccgtaaggtacttaagtcggaacgttaactccggtaagtcccgggttagggggttccggaccggaaccgggtacccggtacccccggtaggggaaccggaaacggggttccggttagggtaaggtgggtaggttacgggggagggtaactccgtaccgtttacccgttagtttaccggtttacgtacgttaacgtaactaaacgtaccgacgtaacgtacggtaaacggttaccgacggacgacggtaacggtacgtaacgtaaccggttaccggaaccgttaaacgtaaaccgtccgaacggtacgactaaccgaccgtactaacgaggtcggtaacgntacggacggttcgaacctcgggacgtacgtacgtacgtaacggacggtaaaccgtccgggtcgttagtaaccggttagttgggaccggtaggtaagtacgtacgttacggtaaaggttaggttaagggtttactacggttcgggtttaccgggg

SEQ ID NO: 173358 - DNA, 716 bp, Homo sapiens
  misc_feature: GYAE6OF01CORF6.48.79.H02.1.454.CMB.1.raw
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (666)..(666): a, c, t, g, unknown or other
  misc_feature (666)..(666): n is a, c, g, or t
tcagagtatacatacacgaccggtgctcgatttagtgtcacacgaagggaaaggggatcacataacaaccacattcctcctctaaaagaagcccctgggagcacagctcatcaccatggactggacctggacggttcctgtttggtggtggcagcagctacgaggtcgtaccacgtcccgaggtnactgtcgtgggtncgtagtcggtggggctaggaggtagaagtacgccgtcgggtccgtggtagtaacgtctaccgngacgtaggtcttaggaggcgacctaccgttnacgcagtactatnaccttagacgacggtcggtggggacaccgaaccgtcccggacccgtaggaacggaacggtgttagggaggtagggaggtagggggacgactaccgtattacccgttagttcgtttaagggtaactaaacgaacctaaacgcgactaacgtagaaccgttccggaaggactaggacgtaccgtaacggtaactaacccgggactaaaccaaacggaccaacggaacaaccgttaacgtaccgaacccgttaagaggttaaccgggcgtacggtaagaccgtaacggaccgtaccgtaaggtaccaagttacccggagggaaaccggtccggtaccggtgttacgttaacgtagtcggaacgnggaagacgtatacggtaaggttgtttacgttaagtccgttcggttaacgg

SEQ ID NO: 173359 - DNA, 715 bp, Homo sapiens
  misc_feature: GYAE6OF01CSK8D.48.79.H02.1.454.CMB.1.raw
  modified_base (158)..(158): a, c, t, g, unknown or other
  misc_feature (158)..(158): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggagttcctctttgtggtggcagcagctacgnggtgtccgacgtcccgaggtgcagcgtggtgcgtggtcgtggggctggaggtaggaagaacggccgttcggggtcccgttcgggtagtaacggttcctcccgtggcgtaagggtccttcgtggacggctaccttcagcagtctatgctagcgagtcggtggtcgccgaccgacggtcccgtaggaaccgaggtcgtggaggtaggaggtcgggaggtacgtactaccttaccgttagttcgtttaggttaacgtaacaacccgtaaacgtaccgactaacgacgtaaacggtccggaggtacgagtacgtaccgacggtaacgtaccggacgaacctatacccgacgaacgctaaccgacgaccgttacgaggtacggacgtggtaacgacgacgtaccggtaccgtagtaacgtacgttaccggtaagggacccgggttaacgaccccgggtggtttaacgttacgtttacggtacggtaggacggtaaacgtgtaacggtacggttaacgttacgggttttagtttacccgttttggtccccgggttaaaccggg

SEQ ID NO: 173360 - DNA, 805 bp, Homo sapiens
  misc_feature: GYAE6OF01DIX4T.48.79.H02.1.454.CMB.1.raw
  modified_base (146)..(146): a, c, t, g, unknown or other
  misc_feature (146)..(146): n is a, c, g, or t
tcagagtatacatacacgaccggtgctcgatttagtgtcacacgaagggaaagggggatcacataacaaccacattcctcctctaaagagcccctgggagcacagctcatcaccatggactggacctggtacggttcctctttggnggtggcacgcacgactacgaggtctccagtcccgaggtcacagctaggcgacgtagtccggtggggctaggacggtacgaagacgtccgtaggtcccgtacgggtagaacggttcctccgtagacgtaacgggtcttacggagggtacggaccttaccgttacgaagccgtacggtactaacgtcgtactacgtcggaacggtcggtacgggtacggaccgtaccggtaccgggtccccgtagggaaccggttacggttacgttagggacggttagggtacggacggggtaggtacctacgtaccgttaccggttattttacgggtaggtaaccgtaacgaacgttaaccgtacgaccgtaacgcgggttaaaccgtacggaaggtacgaaggtacctaacggtaaccggttacccgttaaccgggagtaaaccgtaaccgtccggaaacggactacccgaacggtaccctacccggtaaggtacgtccggtaagaacccgtaggtaccgaaacgtccgaggtagtaccgtaccgttggaacggacccggtcgttaaccgggtaccttaggttaaccgtgttcggaacggacggtaaggtaacttaggacgtttaacggaggttttccttaaacgggttccgtttaccggtaaacgggg

SEQ ID NO: 173361 - DNA, 740 bp, Homo sapiens
  misc_feature: GYAE6OF01C29GY.48.79.H02.1.454.CMB.1.raw
  modified_base (304)..(304): a, c, t, g, unknown or other
  misc_feature (304)..(304): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcgagtccgggctggaggtgaagagccgtgggtcctcggtgaaggtctccgtgccaagggtcttcgtggacggtcaccttcgagtccagctatcgctatcgagcgtagggtgaccgacncggcccctggacagggtcttggagtgggagtagggggacggtactaccgtaacgttcccgttagttaccgttttggtaactacggaactaaaccgttcgaccgaacgtacggtaaacgttccggaaggggtccaacggtacggttaaccacgggtacttaacccgggacggaaacctaactcccggaacgtacggacctaacggaacgtccctaacggtagtacgggacgttccagggaccgtaccggtaacggccccgttaggaaaccggtacgttaccgagggtaacccgggtaacccggtaccgggtaccgtttacggttacgttacccgttgggtaacggacccggtaaggttacggtaccgttaacgggacgggtttaacggtttacggtttaacgtttacggttcccggttaaccgggggtttaaccggg

SEQ ID NO: 173362 - DNA, 784 bp, Homo sapiens
  misc_feature: GYAE6OF01CK52R.48.79.H02.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (634)..(634): a, c, t, g, unknown or other
  misc_feature (634)..(634): n is a, c, g, or t
tcagagtatacatacacgaccggtgctcgatttagtgtcacacgaagggaaaggggatcacataacaaccacattcctcctctaaagaacgccccgtgggagcacagctcatcaccagtggactcggaccgtggacggttccttcgtttggtggtggcagcgagcctacgaggtcgtacccacggtcccgaggtgccgagtcgttggngacgtacggtcggtggggacgtggaggtacggaaggacgtccggttaggggttcccgtggtaggaaggttcctcgngacgtacggtcgttagtggacgtcctaccgtacacgcgtagacttagtcgtactacgtacgacggttcgggtgggtaccgaccggaccggtaccggaccccggtagggaaccggtagggtcggtttaggagggtaggtacgggtaggggacggtacgtaccgtaccgtttaccgttacgtttacgttaaggtacgtaaccgtaacctaaaccgtccgaacgtaacggtaaccggtaaccgggttaccggacggtacgacggtaaccgtaccgaaccgttacggtaacccgtaacggtaaacaacccgttacgaacggacgactaacgaccgtaccaggaacgcggtaacncggtagacggtaccgacgttacgacgtaacgtacgtacggaacggtaccggaccggtttacgggcgttaacggtttaggtacggtacggtagaccgtaagttacgacggttaggttagtcggttaagtttccgtcggttccggttaacgg

SEQ ID NO: 173363 - DNA, 705 bp, Homo sapiens
  misc_feature: GYAE6OF01AGTWE.48.79.H02.1.454.CMB.1.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
tcagagtatacatacacgaccggtgctcgatttagtgtcacacgaagggaaaggggatcacataacaaccacattcctcctctaaagaacgcccctgggagcacagctcatcaccatggactggacctggacggttcctctttggtggtggcagcagctacgaggtgtccagtcccaggtggccagtcgtggtcgcaggttcgtaggggctggaggngaaggacggtccgtgggtccgtggtaggtacgtcctcctaggactaggtccttacggnggtacgacctaccgttcgacgctacgtctagtcgtctacgtcgaggtccggttagggtcgacggaaccggtccggtaccccggtacgggtaaccggtagggttccttagggtaggttaccgggagggtaggggtacggtaacgtccggtaaccttccgttacgtttacgttcgtaagtaactaccgtaaacgtcgaactacgaacgtaacggtaccggacggacgtacggtacgtaccgaaccgtacgtaccggaacgtaacgtaactacgaacggactaccgaccgtacgacctaacgtagacgtacgtcgtcggacgaccgtacgtaccgtagacgtcgacggtcggacgaccgtcggtacgttacgttcgtcggtagccggtagaggaactgtacgtggtacgttaagtttctacggttcgtacggg

SEQ ID NO: 173364 - DNA, 670 bp, Homo sapiens
  misc_feature: GYAE6OF01AXJAJ.48.79.H02.1.454.CMB.1.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
tcagagtatacatacacgaccggtgctcgatttagtgtcacacgaagggaaaggggatcacataacaaccacattcctcctctaaagaaggcccctgggagcacagctcatcaccatggactggacctggaggttcctctttgtggtggcagcacgctacaggtgtccacgtcccaggtgacagcgtcggtgcgnggtcgtgggctggaggtaggaagaacgccgtgggtccgtcggtacgaggtctccncggcgtaacggtcttcgtcgggacggtcctaccgttacacggacctagacttagtacgtactactcggacggtcgtcgggtcgacgtacgaccggtaccgtacggacggtagggtcgtacggacggtagacgggtacgggacggtacctaccgtactaccgttacgtttcggttacggtaacgtacgtaacctaaacgtaccgtagaaccgtaacggtaacggtacggacggacgtacggtacgtaaccgtacgtacggtaccggacgaaacaaccgtacgaacgacgtacacgacgtacgcgagtcggacgctaaggcncggaccncgtagagtacgcgtaagaccgtacgcgcgttacgtactggacgtcggcgtagactagtacgaggttacgttacgtaaagttcgtacgtaacgg

SEQ ID NO: 173365 - DNA, 638 bp, Homo sapiens
  misc_feature: GYAE6OF01ASICH.48.79.H02.1.454.CMB.1.raw
  modified_base (276)..(276): a, c, t, g, unknown or other
  misc_feature (276)..(276): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (495)..(495): a, c, t, g, unknown or other
  misc_feature (495)..(495): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacgaggtcgtccagtcccaggtgcagctggtgcagtcgtgggctgaggtgaagacgccgtgggtcctggtgaaggtctccgtgcgagtctcgtggagcaccttcagcagtctagtgtctntcgagtcggtggtcgcgaccgacggtcccgaggacgaggtctggagtggaggngggaggntctacgtcctacttcgttagtactagaaccaacgtacgctaacgacgtaacgttcggacgggactacggtacgaccgtaacggtacgtaaccggaccgtaactaaccgtaccgaacggtacgaacaccgtaaaccgtcccgtagtacgtacgggtacgngtaacgcgacgtaccggacgtacggtacggtacttaacgggacggttaagaccgggacccggttcgtaacgtttgttaacgtggtaggtacggattaggtagtacaacggttaggttagttacgttcgttccggttaaccggg

SEQ ID NO: 173366 - DNA, 493 bp, Homo sapiens
  misc_feature: GYAE6OF02ISBHA.48.79.H02.1.454.CMB.1.raw
  modified_base (399)..(399): a, c, t, g, unknown or other
  misc_feature (399)..(399): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttctggaggcaccttcagcagctatgctatcagctgggtgcgacaggcccctggacaagggcttgagtggatgggaggatcatccctatcttggtatagcaaactacgcacagaacgttccagggcagagtcacgattaccgcggacaaatccacgancacagcctacatggagctgagcagcctgagatctgacggacacggccgtgtattacgtgtagcgagagatcgagtagtggtattagtcttccgg

SEQ ID NO: 173367 - DNA, 492 bp, Homo sapiens
  misc_feature: GYAE6OF02ICKYM.48.79.H02.1.454.CMB.1.raw
  modified_base (485)..(485): a, c, t, g, unknown or other
  misc_feature (485)..(485): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaggtctcctgcaaggcttctggaggcaccttcagcagctatgctatcagctgggtgcgacaggcccctggacaagggcttgagtggatgggaggatcatccctatctttggtatagcaaactacgcacagaagttccaggcagagtcacgattaccgcggacaaatccacgagcacagcctacatgagctgagcagcctgagatctgagacacggccgtgtacttacgtgtgcgagagatcgagtagtggtttattagtnttaccgg

SEQ ID NO: 173368 - DNA, 507 bp, Homo sapiens
  misc_feature: GYAE6OF02F8HIE.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcgacaaatccacgagcacagcctacatggagctgagcagcctgagactcgtagaggacacgggtccgtagtattacgtgtgcgagagatacgaggtaggttaggttattacgtcgttaccgg

SEQ ID NO: 173369 - DNA, 526 bp, Homo sapiens
  misc_feature: GYAE6OF02IOEMX.48.79.H02.1.454.CMB.1.raw
  modified_base (419)..(419): a, c, t, g, unknown or other
  misc_feature (419)..(419): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttggagtggatgggaggatcatcctatcttggtatagacaaactacgcacagaagttccaggcagagtcacgtacttaccgacgaacaaatccaacgagcacagcctacatgganctgagcagcctagagatcgtggaacggaccacgggccgtagttaacttcgtggttacggacggagtagagtcgaaggtaggttaggtttaattacgtcgttaccggg

SEQ ID NO: 173370 - DNA, 488 bp, Homo sapiens
  misc_feature: GYAE6OF02GOQIN.48.79.H02.1.454.CMB.1.raw
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctanatgganctgagcagcctgagatcngaggacacggcctgtatactgtgcgagagatcagtagtggtattatctaccgg

SEQ ID NO: 173371 - DNA, 495 bp, Homo sapiens
  misc_feature: GYAE6OF02H4748.48.79.H02.1.454.CMB.1.raw
  modified_base (414)..(414): a, c, t, g, unknown or other
  misc_feature (414)..(414): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctggtgcgacaggcccctggacaagggcttgagtggatgggaggatcatccctatctttggtatagcaaactacgacacagaagttccaggcagatcacgattaccgcggacaaatccacgagcacagcctacatgganctgagcagcctgagatctgaggacacggcctgtattacgtgtagcgagagatcgaggtagttaggttattacgtctaccgg

SEQ ID NO: 173372 - DNA, 514 bp, Homo sapiens
  misc_feature: GYAE6OF02F10P3.48.79.H02.1.454.CMB.1.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatcctatctttggtatagcaaactacgcacagaagttccgagggcagagtcgaacgattaccgcggaacaaagtccaacgagacacagccctanactggancgtagagcagccgtagagtatcgtagacggacaccgggcctgtacttacgtgtgacgagagatcgaggtagttggttattgtcgttacgg

SEQ ID NO: 173373 - DNA, 500 bp, Homo sapiens
  misc_feature: GYAE6OF02FGXNL.48.79.H02.1.454.CMB.1.raw
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatgganctgagcagccctgagattcngacggacacggccgttgtacttacgtgtgcgagagatcgagagttggttattagtcttaccgg

SEQ ID NO: 173374 - DNA, 523 bp, Homo sapiens
  misc_feature: GYAE6OF02HDCRX.48.79.H02.1.454.CMB.1.raw
  modified_base (422)..(422): a, c, t, g, unknown or other
  misc_feature (422)..(422): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttctggaggcaccttcagcagctatgctatcagctgggtgcgacacggcccctggacaagggcttggagtggatgggagggatcgatccctatctttggtatagcaaactcgcacagaagttccaggcagacgtcacgattaccgcggaacaaatccaacgagcacacgcctacagtgganctgagcagcctgagactcgtaggacggacacgggccgttagtactttacgtggtgacggagacgatacgaggtaggttggttaacttagtccgttaccggg

SEQ ID NO: 173375 - DNA, 493 bp, Homo sapiens
  misc_feature: GYAE6OF02JHQL4.48.79.H02.1.454.CMB.1.raw
  modified_base (430)..(430): a, c, t, g, unknown or other
  misc_feature (430)..(430): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcgatccctatcgttggtatagcaaactacgcacagaagttccagggcagagtcacgattacgcggacaaatccacgagcacagcctacatggagctgagcagcctganatctgacggacacggcgtgtatacgtgtcgcgagagatcgagtagtgttacttatcttaccgg

SEQ ID NO: 173376 - DNA, 605 bp, Homo sapiens
  misc_feature: GYAE6OF02G0JAW.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacacggcccctggacaagggcttggagtggagtgggagggatcatccctatcgttggtatagacaaactacgacacgaagtaacgttccgagggcaagacgtacaacggtatttaacccggacggaaccaaatcccgaacgacgaccaaccaacgaccctaacgatggaagtcctaggacgccgacgcccgtaggaacggtatccgttaggaacggtaaccgaccgggtccgttaggttaacgtttaccgttggtacggacggaaggaacgtagtaccgaggtaaggtttaggtttaacgtttacgttccgttacccgggg

SEQ ID NO: 173377 - DNA, 514 bp, Homo sapiens
  misc_feature: GYAE6OF02IO5F3.48.79.H02.1.454.CMB.1.raw
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttctggaggcaccttcagcagctatgctatcagctgggtgcgacacggccctggacaagggcttggagtggagtgggagggatcatcctatcttagtatagacaaactacgcacagaagttccaggcagagtcacgactaccgngaacaatccagagcacagcctacatgganctgagcagcctgagatcgtaggacggaacacggtccgtagtatttacgtggtacgcggaagagtatacgaggtacgttggttaattacgtcgttaccggg

SEQ ID NO: 173378 - DNA, 498 bp, Homo sapiens
  misc_feature: GYAE6OF02GV3UU.48.79.H02.1.454.CMB.1.raw
  modified_base (430)..(430): a, c, t, g, unknown or other
  misc_feature (430)..(430): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctggtgcgacaggcccctggacaagggcttgagtggatgggaggatcatccctatcgtttggtatagcaaactacgcacagaagttccaggcagagtcacgattaccgcggacaaatccacgagcacagcctacatggagctgagcagcctgagntcgtgagacgacggccgtgtacttacgtgtgcgagagatcgaggtagttggttattacgtcgtaccgg

SEQ ID NO: 173379 - DNA, 757 bp, Homo sapiens
  misc_feature: GYAE6OF02JRAE5.48.79.H02.1.454.CMB.1.raw
  modified_base (567)..(567): a, c, t, g, unknown or other
  misc_feature (567)..(567): n is a, c, g, or t
  modified_base (668)..(668): a, c, t, g, unknown or other
  misc_feature (668)..(668): n is a, c, g, or t
tcagagtatacatacacgaccggtgctcgatttagtgtcacacgaagggaaaggggagtcacataacaaccacattcctcctctaaagaagcccctgggagcacagctcatcaccatggactggacctggaggttcctctttgtggtggcgagcagctacaggtgtccagtcccaggtgcagcgtggtgcagtcgtggggctggaggtgaagaaggccgtgggtcctcggtggaggtctaccgtgcgaaggtcttcgtggacggtcctaccttcgacgcgagtactagtcgctagtcaggtcgtgggttcgacggaccgacggtcccccgtaggaccgaaagggtccgttaggaggtagggtaggttacggggaaggggtactacgtaaccgttcccgttaagtttccgtttaagggttaacgtagggtaaacctaaaaccgttaccggaactaaccggtaaacggttacggtttaccggaggggtacaacgggtaagtaccgaacgtacgtaccggtacgggaaactaaacgtacccaacggacgtaccgacgtacgaacccgtanaggtacgacgtcgtacggacgtacacggacccggtagtaacgtacgttacgacgggaacggtaaccgaccggggtaccggttagttaacgtttacccgggngttaccggggacgttaacgggtaacggtacgttacggttagggtaaccggttttaggttttaacggttaccggtttcggttaacccggg

SEQ ID NO: 173380 - DNA, 629 bp, Homo sapiens
  misc_feature: GYAE6OF02IJTEC.48.79.H02.1.454.CMB.1.raw
  modified_base (277)..(277): a, c, t, g, unknown or other
  misc_feature (277)..(277): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagccgtgggtcctcggtagaaggtctcctgcgaaggtcttcgtgggacgctaccgttcagcagcttancgctatcgagcgtgggtcgcgacgacggtccccgtaggaacgaagggtcttggaggtggagtggggaggtatcgactcccgttattcgtttaggtaatacgactaaacgtcgacaacgtaagtaacgtccgaggacaggacgtacacgtacgttaaccggacggaaaccaaagtcccgaacggacgaccaaacgacgtaccctaacgaggtacggacgtccgaggacgtaccgaacgtccgaaggacgtaacgtcgtaaggacgaccgaccggtcgtagttacgtttagcggtacgacgaagtacgtagtcggaaggtacggttttaggttaactttcgtccggttaccggg

SEQ ID NO: 173381 - DNA, 521 bp, Homo sapiens
  misc_feature: GYAE6OF02FZHU3.48.79.H02.1.454.CMB.1.raw
  modified_base (397)..(397): a, c, t, g, unknown or other
  misc_feature (397)..(397): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggagtgggaggatcatccctatcgttggtatagcaaactacgcacagaattccaggcagagtcacgattaccgcgacaatccacgancacacgcctacagtggagctgacgcaaggcctagagtagtcgtgacggacgacgggccgttagtagttacgtggtagcggaagagtagtcgaggtaggttaggttacttacgtccgttaccggg

SEQ ID NO: 173382 - DNA, 504 bp, Homo sapiens
  misc_feature: GYAE6OF02IVFSE.48.79.H02.1.454.CMB.1.raw
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaggtctcctgcaaggcttcgtggagcaccttcagcagctatgctatcagctgggtgcgacaggcccctggacaagggcttgagtggagtgggagggatcatcctatctttggtatagcaaactacgcacagaagttccaggcgagagtcacgtataccgcggacaaatccacgancacacgcctacatggagtcagancagcctgagatctagaggcacggcgtcgtattacgtgtgacgagagtatacgacggtagttaggttacttagtcgttacggg

SEQ ID NO: 173383 - DNA, 598 bp, Homo sapiens
  misc_feature: GYAE6OF02G34YT.48.79.H02.1.454.CMB.1.raw
  modified_base (282)..(282): a, c, t, g, unknown or other
  misc_feature (282)..(282): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaacttcagcagctatgctatcagctgggtncgacacggcccctggacaagggcttggaggtggagtgggagggatcacgtccctattcgttaggtatagactaaactacgcaacgagaacgttccgagggacaggacgtcacgtacttaccgacggtaaccaaactccgacgacgaccaaccaaggtaccctacagtacggagtctaggagccgacgtcctgaacgtatcgtaggaacggaccgacgggtcccgttaggttaactttaccgtggtacggacggtaaggaacggtagtaccggaaggttaggttacggtttaactttaccgtccgtttaacccgggg

SEQ ID NO: 173384 - DNA, 495 bp, Homo sapiens
  misc_feature: GYAE6OF02FYRBH.48.79.H02.1.454.CMB.1.raw
  modified_base (473)..(473): a, c, t, g, unknown or other
  misc_feature (473)..(473): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggatcatccctatctttggtatgacaaactacgcaacagaagttccagggcagagtcaacgattaccgcggaacaaatcccacgagccacagccctacatggagctgagcagcctagagatctgaggacacggcgtgtattacgtgtgacgaganatcagagtggttattatctcgg

SEQ ID NO: 173385 - DNA, 620 bp, Homo sapiens
  misc_feature: GYAE6OF02HU0UZ.48.79.H02.1.454.CMB.1.raw
  modified_base (325)..(325): a, c, t, g, unknown or other
  misc_feature (325)..(325): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagctgggtgcgacacggcccctggacgaaggtcttgagtggagtgggaggntcactcctatctttggtatagactaaactacgcaacagtaacgttccgagggacagagtacacgtactaccggacggaacaaactccgaacggagaccaacgacgaccttaacgagttcgggacgcctaggacgaccaacggcccgtaggacgtacgttaccgtagggaaacggaccgaccggggtccgttacgtttaacgtttaacgtcgggttaggaccggtaaggtaacgtaacgttacggaaggttaggtttaacgggttttaacttttacggtacccgtttaacccgggg

SEQ ID NO: 173386 - DNA, 590 bp, Homo sapiens
  misc_feature: GYAE6OF02HBYK3.48.79.H02.1.454.CMB.1.raw
  modified_base (284)..(284): a, c, t, g, unknown or other
  misc_feature (284)..(284): n is a, c, g, or t
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
tcagagtatacatacacgaccggtgctcgatttagtgtcacacgaagggaaaggggatcacataacaaccacattcctcctctaaagaagcccctggggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttctggaggcacctttcagcagcctatgctatcagctgggtncggacacggccccctaggaccaaaggggccttaggagtcggagttggggagggactcgactcccttagttctttggtatacggacaaacgtcgacacgaagaacgttcgagggcagagtcacgtattaccgacggaacaaactccacganccaacagacctagagtgggacncgtagacgcaggcctgaagactcgtcggaacggaaccgccgggtaccgttagttacgtttaacgtcggttacgacggtaagaacgtactaccggtaggacggtttggtttaagtttactacggtttacccgggg

SEQ ID NO: 173387 - DNA, 611 bp, Homo sapiens
  misc_feature: GYAE6OF02HU1ED.48.79.H02.1.454.CMB.1.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtctcggtgaaggtctcctgcaggcttctggagcaccttcagcagctangactatcgagcgtggngcgacgacggcccctggacgaagggtcttggaggtggagtgggaggatcatcctatcgtttggtatagactaaacgtcgacgacaagtaacggttccaggggctaacgacgtcgacggtaattacccggacgtaacaaacttccgaaacggacgtaccgaaccacgtaacccctagaacgtggaacgcgtagacgtaccgacgccgtaggagtacgttacgtaggaaccgggtaacgaccggtccgttagttaacgttaccgttacggtacggacggtagaacgtagttaccgaaggttacggttaggtttacgttactccggttaccggg

SEQ ID NO: 173388 - DNA, 559 bp, Homo sapiens
  misc_feature: GYAE6OF02JBVAE.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctggtgaaggtctcctgcaaggcttctggaggcaccttcagcagctatgctatcagcgtgggtcgcgacacggcccctggaccgaagggtcttggaggtggagtgggagggatcatccctattcttggtatagacaaactacgcacagtaacgttccagggtcagagtacacgtacttaccggacggaaccaaactccgaacgaacgaccaacacgcctaacagtcggactcgtagagcgacgccgtaggcgtatcgtaggacgaacgaccggtcgttagtacttacgtggtagacgagacgtatacgaggtacgttaggttacttagttcgttacccggg

SEQ ID NO: 173389 - DNA, 641 bp, Homo sapiens
  misc_feature: GYAE6OF02JP4MZ.48.79.H02.1.454.CMB.1.raw
  modified_base (227)..(227): a, c, t, g, unknown or other
  misc_feature (227)..(227): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtagnacgtctctgacgaggtcttcgaggacgacctaccgttcacgacgagtacttagcgtacttagtcgacgtcggtgggtcgacgacgaccggtccccgtaggaaccggacggtcgtaggaggtaggtaggagggggaggactacgtaccttaccttattacgtttaggtaatacgaacctaaacgtacgacaagaagtacgtacggaggactagagtacgaacgtacgtaccggacgaaactaaacacgaacgacgaccaacgactacctaagacgtagacgacggtacgacgacgacgtacgagaacgtactcgaaggaccgaacggaccggtacgttaacgttacttacggtacggtacggaaggaagaacgttacgaacggtaggttaggttacgttttactacgttaccggg

SEQ ID NO: 173390 - DNA, 694 bp, Homo sapiens
  misc_feature: GYAE6OF02HFJ55.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctggaggtgaagagcctgggtcctcggtgaggtctcctgcgagcttcgtggaggctaccttcagcagctatgctatcaggccgtgggtcgcgacgacggtccccgtaggacgtagggtcttaggaggtagggagtgggggaggtactacgtacttaccgttagtttcgtttagggtaacttacgtaaccgtaaacgttaccgactaacgtaacgtaacggtttacccggaaggggtccaagggtaacgtaccgaaccgggtaacgttaacccggaccgggtaaactaaaacgtcccgaaacggtacgaacccgaccggtacgtaacccgtacgaaggttccgggacgtaccggtaggacgaccgtacggtaccgttagaacgtacgttacgaggtaccggaacgtccgggtacgtcgttaacgttcggtagggtacgacgggagtacggaacgtcggtaaggtacggttaggtttacttacgtccggttaaccgggg

SEQ ID NO: 173391 - DNA, 656 bp, Homo sapiens
  misc_feature: GYAE6OF02HIC1G.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttctggaggcaccttcagcagctatgctatcagctgggtgcgacaggcccctgggacaagggcttgagtggatgggagggatcatccctatccttggtatagacaaactacgacacaagaacgttccgaagggcaaggacgtacaacggtatttaacccggcggtaacaaaacttccgaacggacgaccaaccgaacggtacccttaacgaagttacgggaacgtcgttaggaagtccaacgggcccctagggaacgtacttccgtaagggaacgggaaaccgtacccggggtacccgggttaggttaacgttttaccggtgggttaaccggcggtaaacggtaacggtaacgttacggaagggttaacgggtttacgggtttaacttttaacggttcccggtttaacccggggg

SEQ ID NO: 173392 - DNA, 695 bp, Homo sapiens
  misc_feature: GYAE6OF02H9FOH.48.79.H02.1.454.CMB.1.raw
  modified_base (546)..(546): a, c, t, g, unknown or other
  misc_feature (546)..(546): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagccgtgggtcctcggtgaaggtctcctgcaaggtcttcgtggaggcctaccttccgagtcaggcttatgctatcgagtccggtgggtgacggacgacggtcccccgtaggaacgaaggggtcttaggaggtagggagtggggacgggtagtaccaacgttcccttaagttccgttttacggttaagtaaccgaacctaaaaaccgttacgaccgtaaacgtaacgtaaacggttacccggaaggggtcgaacggtacgttacgaaccggtaacgttaacccggacgaaaccgtaaactaccgaacgacgtaccacgacgacctacgagtcggtacnctaggacgccgacgccgtaggacgtatacgtacggacggtaccgaccgggtaccgttacgttacgtttaccgtaggtaccggtacggaggtaacgtacgtacggtaaggtaggtttacggttttaagtttaccgtaccggttaccgggg

SEQ ID NO: 173393 - DNA, 526 bp, Homo sapiens
  misc_feature: GYAE6OF02FR5NL.48.79.H02.1.454.CMB.1.raw
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaggtctcctgcaaggcttctggaggcaccttcagcagctatgctatcagctgggtgcgacaggccccgtgggccaagggcttgagtgggagtggggagggatcgactccctattcgtttgtatagcaaactacgcacaagaagttccgagggcagagtcaacgattaccgcggacaaanccacgagcactagcctacatggnctgagcagcctgagatctagaggacaccgaccgtagtacttacgtggtcgacggaagagtagacgaacggtaggttaggtttaattacgtcgttaccggg

SEQ ID NO: 173394 - DNA, 633 bp, Homo sapiens
  misc_feature: GYAE6OF02IFWHE.48.79.H02.1.454.CMB.1.raw
tcagagtatacatacacgaccggtgctcgatttagtgtcacacgaagggaaaggggagtcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagaagcctgggtcctggtgaaggtctcctgacaaggtctttcgtggaggtcctacctttcgagtccaggctaagtcgactatcagcgtgggtgcgacgacggcccctagggacgaacgggtctttaggacggttggagtggggaggtactcgtactcccgttagttccgtttaggtacttacgactaaacgtcgactacgaagacgttccgaggtctacgagtcgacgtacgttaccgaggaacctaagtccagagaccgacgtacgacctacgagttcggaagctaggacgtcgtacggccctaggacgtacgttcgtaaggacggtaccgtaccgggtcgttaggttacttacggtcggttacggcggtaacggacgtagtcgtaaggttaggttacggtttacttaccgttcgttacccgggg

SEQ ID NO: 173395 - DNA, 776 bp, Homo sapiens
  misc_feature: GYAE6OF02IQ237.48.79.H02.1.454.CMB.1.raw
  modified_base (304)..(304): a, c, t, g, unknown or other
  misc_feature (304)..(304): n is a, c, g, or t
  modified_base (753)..(753): a, c, t, g, unknown or other
  misc_feature (753)..(753): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttctctttgtggtggcagcagctacaggtgtccagtcccaggtgcagctggtgcagtctggggctgaggtgaagagccgtgggtccctcgggtgaaggttctcccgtgactaaggtccttcgtgggaggccaccttcagcaagcctaatcgtcctagtcacgcgtggggtcncggaacgtcggccccgtaggacggaagggtcttggagtggagtggggaggtctacgactccgtattcgttaggtacgtacgaaccaaacgttccgacaaacgtaacggtaacggttacccggaaggggtaccgtaaggtacggtaccgtaacgttaacccggttaaccccgggtaacgggtaacccgaaaaccggttacccgaaaccgggttacggaaccccgaacccgtaccgggtaacccttaacccggtaaagttcggggtaaacccggtcggtaccgggtaccgaaccgtacgggtaccccctaggggtaacgtaaccgttaccgggtaacgaaacccgggtaacggggaacccgggtttaccggttacgttaacggtttaaccgcgggttacgtaaaccggggtaggtaacgtacgttaggaaaccgggttggttaagggtttntaacggtttcccgttaacggggg

SEQ ID NO: 173396 - DNA, 589 bp, Homo sapiens
  misc_feature: GYAE6OF02GSKUY.48.79.H02.1.454.CMB.1.raw
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttctggaggcaccttcagcagctatgctatcagcgtgggtgcgacgacggcccctaggacgaagggcttggacgtgggagtggggaggatcgactcctattcgtttaggtatagactaaactacgacacagtaacgtccgagggcagagtcaacgtacttaccggcgaactaacgtccacgagccaacncgtacctanacgtaggacgtcgtagacgcgagccgtagagacttacgtaggacgtaccgacgggtccgttaggttacgttacggtcggtcgtaccggaggtaacgtacgtacggtaaggtacggtttacgggttttatttacgtccgtttaacccgggg

SEQ ID NO: 173397 - DNA, 536 bp, Homo sapiens
  misc_feature: GYAE6OF02FILRP.48.79.H02.1.454.CMB.1.raw
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttggagtggagtggggagggatcactcctatctttggtatagcaaactacgcaacgagaagttccgagggcagagtcacgattaccgacggaacaaatccgacgagacacagcctanatgganctagagacaggcctagagattcgagaggacacggtcgtgttacgtacgtgtggaccgaaggacgtaagtcgaggtaggttagggtttactttacgttccgttaccgggg

SEQ ID NO: 173398 - DNA, 590 bp, Homo sapiens
  misc_feature: GYAE6OF02F269F.48.79.H02.1.454.CMB.1.raw
  modified_base (289)..(289): a, c, t, g, unknown or other
  misc_feature (289)..(289): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagcgtgggtgcgacncggcccctggacgaagggcttggagtggagtgggaggatcgactccctattcgtttaggtatagactaaactcgacacagtaacgttccgaggcagacgtcaacgtacttaccgacggtaacaaactcccgaacgagacacacggtacctaacgagtacggacgcgtaggacgcgacgccgtagagtacgttcgaggacggaaccgtacgggtccgttagttaacgttacgttggtacggacggtaaggagaacgttacggaacggttaggttaggttttattacgttcccgtttaccggg

SEQ ID NO: 173399 - DNA, 768 bp, Homo sapiens
  misc_feature: GYAE6OF02I5RCV.48.79.H02.1.454.CMB.1.raw
  modified_base (162)..(162): a, c, t, g, unknown or other
  misc_feature (162)..(162): n is a, c, g, or t
  modified_base (185)..(185): a, c, t, g, unknown or other
  misc_feature (185)..(185): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (692)..(692): a, c, t, g, unknown or other
  misc_feature (692)..(692): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctcttgtggtggcagcagctacaggtntccagtcccaggtgcagctggtncagtctgggctgaggtgaacgagtccggttcngtcgtacggtcgtaagtacgtcctagctaacgnggtacgttcggaacggtacgtacgtaccgtacgacgtaagtacgtacgtacgttaacgtacgtacggtacggtacggtacggtacggtaccgtacggtaccggtacggtaaccggtaacgggtacggttacggtacggtacgggtaaggtacgggtacggtacgtacgtacgtaccgttacgttacgttacgtacgtaacgtaacgtaacgtaacgtaacgtaacgtaacgtaacgtacgtacggtacgtacgtaacgtaacgtaacgtaacgtaaccgtaacggtaaccgtaaacgtaacgtaaccgtaacgaaccgtaaccgtaacgtaaccgtaacgtaacgtacgtaacggtacggtacgtaacgtacgtacgtaacgtaacgtaacggtaacgtacgtacggtaacggtaaccggtaaccggtacggttacgttaancggttacggtaacggtaacggtacggtaacggtaacggtaacggtaacggtaacggttacggttaacggttaacgg

SEQ ID NO: 173400 - DNA, 624 bp, Homo sapiens
  misc_feature: GYAE6OF02I3H24.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggtcttcgtggacggcaccttcagcagctatgctatcagctgggtgcgacgacggccccgtggacaagggcttggacgtgggagtgggagggatcgattccctatcgtttgtatacgtacaaacgtaccgacaacgaagtaacgttaccgagggaccaagtacgtaccaaccggtaattaaccccggcggaacctaaaactccgaaccggtagacccaacgtaacgaccctacgaacgtggacgactaggacgacacggtacctaggaacgacttcgtacggacggaaccgaccgggtaccgtagttacgtttacgtcggtcgacggaagtacggtaacgtcggaaggttaggttacggtttaatttacgtccgtttaaccgggg

SEQ ID NO: 173401 - DNA, 563 bp, Homo sapiens
  misc_feature: GYAE6OF02GJ85V.48.79.H02.1.454.CMB.1.raw
  modified_base (445)..(445): a, c, t, g, unknown or other
  misc_feature (445)..(445): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctcctgcaaggcttcgtggaggcaccttcagcagctatgctatcagctggtgcgacacggcccctgggacaagggcttggagtggagtggggaggatcgatcctatctttggtatagacaaactacgcaacgagtaacgttccgagggtcagtacgtacacggacttacccggacggaacctaaactccgaacgaacgccaaccgacgaccctaanagtacggcgactggagcacgcgtgagtagtcgtagacggacgaccggtcgtagttacttacgtgtacgacggaagagtactagaggtaggttacggtttattacgtaccgttaccggg

SEQ ID NO: 173402 - DNA, 637 bp, Homo sapiens
  misc_feature: GYAE6OF02HMJPP.48.79.H02.1.454.CMB.1.raw
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (607)..(607): a, c, t, g, unknown or other
  misc_feature (607)..(607): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctggaggtgaagagccgtgggtcctcggtgagtctcgtgcaggtcttcgtggagctaccgttcagtcagctatgctatcgagtcgtgggtcgcgaaccgacggtccccgtaggaccgaaggtcttaggacggttagggagtaggggaggtactcctacgtcccgtagttccgttaggtagtacggtaacctaaaccgtacgtaccgaacgtaacggtaacgttcccggtaagggaccgtaggtacgtaaccgtaaccgtacgttaaccggaccggaaacctaaacgtacccgaacgacgaaccaaccgtacgaacccgttacgaggttaccgggaagtcgtagacgtcgacgtccgagaacgtntacgnggtacgacgtcgacgtgtaacgtcgagtgacggtagacggtntacgagtagttaggttatcgtagtaccggg

SEQ ID NO: 173403 - DNA, 606 bp, Homo sapiens
  misc_feature: GYAE6OF02F9H5X.48.79.H02.1.454.CMB.1.raw
  modified_base (467)..(467): a, c, t, g, unknown or other
  misc_feature (467)..(467): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggcctcggtgaaggtctcctgcaaggcttcgtggaggcaccttcagcagctatgctatcagcgtgggtgcgacgacggcccctggacgagggcttggagtggagtgggagggataccacgtcccttaagttccgtttaggtatacacgtaaacgtacgcaacgtagtaacgttaccgagggtacagacgtaccaacggtacgttacccggacggaacaaacgtcccgaaggacgaccgacgaacgtacccgtanaacgtacgggacgtcgtacggacgcaacggtcctaggacgtactcgtagacggacgaccggtcgttagtaacttaccgtggtacgacggtagagtacgtacgacggttaggttaggtttacttacgtccgttaaccggg

SEQ ID NO: 173404 - DNA, 532 bp, Homo sapiens
  misc_feature: GYAE6OF02IKH9O.48.79.H02.1.454.CMB.1.raw
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
  modified_base (406)..(406): a, c, t, g, unknown or other
  misc_feature (406)..(406): n is a, c, g, or t
  modified_base (474)..(474): a, c, t, g, unknown or other
  misc_feature (474)..(474): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagagcctgggtcctcggtgaaggtctcctgcaaggcttcnggaggcaccttcagcagctatgctatcagctggtgcgacaggcccctggacaaggcttgagtggatgggnggatcatccctatcttgtatagcaaactacgcacagaattccgaggcagagtcacgattacgcgacaatcacgagcgacacgctacatggancgtacgagccaggccctaggtagagttacctaggaacggaaccacgggacccgtaggtactttaccgnggttagccggtaaggacgtaatacgacgtaaggttggtttaacttagtcgttacccgg

SEQ ID NO: 173405 - DNA, 709 bp, Homo sapiens
  misc_feature: GYAE6OF02JJ7W9.48.79.H02.1.454.CMB.1.raw
  modified_base (255)..(255): a, c, t, g, unknown or other
  misc_feature (255)..(255): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagttcccaggtgcagctggtgcagtctgggctgaggtgaagagcctggtcctggtgaaggtctcgtgcaggtctcgtggagctaccttnacgcagctatgtactatccgagcgtgggtgtacggaccgacggtcccccgttagggaaccggtaaagggcctttagggacggtagggtaaggttcggggaggggtaacttacgtaaccgtacccctttaagtttaccgttttaggggtaacttaacggtaactaaaaccggttacccgaacgtaaacccgaacggtaaacggtttaccgaaaccggggcgtaacgggtacggtaccgtaaccgtaacgttaacccggccggtaaaacgtaacgtaacccgaacgtaacgaccgaaaccgtacgtaccctacgtacgacggtacgtaccgacggaacgccgtaacgacgttagaagtcgtacgtaggacggtaacgcgggaccgttgtaacgttcggtgttacgagtaggtactaagtccgaggtaggttacgttaagttccgtacggttaccgg

SEQ ID NO: 173406 - DNA, 697 bp, Homo sapiens
  misc_feature: GYAE6OF02IMG6G.48.79.H02.1.454.CMB.1.raw
  modified_base (248)..(248): a, c, t, g, unknown or other
  misc_feature (248)..(248): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctggaggtgaagaagcctgggtcctcggcgaaggtctcctgcaaggcttcgnggagctaccttcagcagtctagtcgctatcgagtcgtggggtcgcggaacgaccggccccgtagggaaccgtaacgggtcgttaggacggtgggaggtaggggaacggggtactaccgtaacgtcccttagttacgtttaggtaacttacggtaaccgtaaacgttaccgaccgtaacgtaacgtaacggttaccgacggggtacacggtacgtaccgtaacggtaaccgtttaacccggaacggtaaaccctaaaagtcccgaaacgacgaaccgaacgaaccgtaccctaacgtagttacggacgtacgtaggacgacgacgtactagacgtactcgtaaggacggaacgtaccggtacggttacgttaacttcggtcgtacggtacggtaaggtagtacgttcgaagggttacggttacggtttacgttacgttcccgttacgggg

SEQ ID NO: 173407 - DNA, 686 bp, Homo sapiens
  misc_feature: GYAE6OF02IPW4X.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtgggtcctcggtagaacggtcctccgtgaccgaaggtcttcgtggacggctaccttcagtcagctatgctatcagtcgtgggtcgcgacgacggccccgtggacgagggcttaggaggtaggacggtagggagggtagtacgtaccgtccttagttcgttaggtatacgtacaaacgtacgacgtaacgtaagaacgttaccgacggtactagacgtaccgacgtacgttaaccgggacgaacctaagtacccgaacggtaacgaccgaaccgacgaacccgttaaacgacggttacggacgtaccgtaggaacgacgtacggtaccgtagtaaccgtagttaccgtaaggaaccggtaaccgtaccgggttaccggttacggtttaacgttacggttacggtaccgtaggtaacgtaagtacgtaacgtaggttaggtttacggtttactttacggtacccggtttaaccggg

SEQ ID NO: 173408 - DNA, 561 bp, Homo sapiens
  misc_feature: GYAE6OF02GDXIM.48.79.H02.1.454.CMB.1.raw
  modified_base (288)..(288): a, c, t, g, unknown or other
  misc_feature (288)..(288): n is a, c, g, or t
  modified_base (464)..(464): a, c, t, g, unknown or other
  misc_feature (464)..(464): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagcgtggtgcgacnggccctggacaagggctgacgtggagtgggaggatcgactcctagttcttaggtatacgactaaactacggcacagaagttccgagggcagacgtcacgtacttaccgcggaacaacgtccaacgacgcacacgacctacacgtggagctaggacgcacgcctagacgtactacgngaacggacgacggtaccgtagttagttacgtgtacggtacgaagtacgtacgttacgaaggtaggtttaggttaacgtttagtccggtttaaccggg

SEQ ID NO: 173409 - DNA, 660 bp, Homo sapiens
  misc_feature: GYAE6OF02HINM8.48.79.H02.1.454.CMB.1.raw
  modified_base (284)..(284): a, c, t, g, unknown or other
  misc_feature (284)..(284): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcgtgcaaggcttctggagcaccttcacgcagctatgactatcagtctgggtnacgacgacggcccctaggaaccgagggcttggaggtgggacgtggggagggtatccgacttccctatcgtttaggtattacgaacctaaacgtacgacaaccgaagtaacgttaccaggggtcacggtacgtaccaacggtactaccggacggaaacaaactccgaacgacgccaaccgacgcctaacacgtggaacgcgtaggacgcaacggtccgtaggtacgacgttaccggtaggaaccgggtaacccggtacggggttaccccgttagggttaactttaaccgggtcgggtacgggtacggtaacggtaagtaacgtccggaaaggttccgggtttaaggtttacgtttacgttcccggtttaacccgggg

SEQ ID NO: 173410 - DNA, 607 bp, Homo sapiens
  misc_feature: GYAE6OF02HKKIN.48.79.H02.1.454.CMB.1.raw
  modified_base (555)..(555): a, c, t, g, unknown or other
  misc_feature (555)..(555): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctggaggtgaagagcctgggtcctggtgaggtctcctgcgaaggtcttacgtggacggctaccgttcagcagtctatcgctatcagtcgtgggtgcgacgacggccccgtaggacgagggtcttaggaggtggagtggggaggtactcgacttccttagttcgttaggtaacgtacgtaacctaaactacgactaacgaagtaacgtaccgaggacaggtacgtaccgaacgtacgttaacccggacgaaccaaacgtccgaacgacgaccaacgaccgtacctaacgacgtggacgagtacgaccgcgtacgtcgagtagtactcgtaggacggtaccgacgtcgttagtatttacggngttcgacggagagagtagtacggtagtttaggtttacttcgtcgttaacggg

SEQ ID NO: 173411 - DNA, 654 bp, Homo sapiens
  misc_feature: GYAE6OF02HEE22.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagagccgtgggtcctggtgaggtctctgcaggctctggacggcaccttcagcagctatgctatcagtcgtagggtcgcgacgacggccccgtaggacgaagggcgttgaggtggagtggggaggatcgacttccgtattacgttggtatacggactaaacgtacgactaacgacgtaacgttccggaggacacggtacgtcgaacgtactaccggtacgaactaactaccgaacgacgacaacgacgtacctaaccgtagtacgggactacgtaacgtacgacgacgtaccgtaggaaacgtacggttacgtagggaacggaacccggtaccgggttccgggttacgttaacggtttcgtaacggtacggaccgggtaaggtaccggtactacggtaacggttacgggtttacggttttaagttaccggtttacccggttaacccggg

SEQ ID NO: 173412 - DNA, 773 bp, Homo sapiens
  misc_feature: GYAE6OF02G0JVV.48.79.H02.1.454.CMB.1.raw
  modified_base (247)..(247): a, c, t, g, unknown or other
  misc_feature (247)..(247): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagaagccgtgggtcctggtgaaggtctcctgcaaggcttcgnggaggccaccttcgagcgagctatcgctatcagcgtgggtcgcgacgacggtccccgtaggaccgaagggtccttaggaggtggacggttgggggaacgggtacgttaccgtaaccgttacccgttaacgtttacccggttttagggttaacgtttaacgaaccgtaaaaccgttaaccggtaccgaaacgtaacgggttaaacggtttacccggaacgggggtaccgaaggtaccggttaacgaaacccggttaacgttaaaccccgggtaaccgggtaaactaaaaccgtacccgaaacgggtaccggaacccgaaccggaaccgtaccccgtaacgtacgtacgggaacggtacgtacggacgtacgaccgtaccgtacggaagtactacgtaacggacggaaccgtaccgggtaccggttagttaacggtttacgtcggttacggtaacggtacggaagtacgtaaccggtagggttaccggtttacggtttaagttttaccgttacccggtttacccgggg

SEQ ID NO: 173413 - DNA, 689 bp, Homo sapiens
  misc_feature: GYAE6OF02JF6QW.48.79.H02.1.454.CMB.1.raw
  modified_base (187)..(187): a, c, t, g, unknown or other
  misc_feature (187)..(187): n is a, c, g, or t
  modified_base (263)..(263): a, c, t, g, unknown or other
  misc_feature (263)..(263): n is a, c, g, or t
  modified_base (334)..(334): a, c, t, g, unknown or other
  misc_feature (334)..(334): n is a, c, g, or t
tcagagtatacatacacgaccggtgctcgatttagtgtcacacgaagggaagggatcacataacaaccacattcctcctctaaagaacgcccctgggagcaccagctcatcaccatggactggacctggaggttcctctttgtggtggcagcagctacaggtgtcccagtcccaggtgcagctggtncagtctggggctgaggtcgaagagcctgggtcctcgggtgaaggtctcctgccaaggcttcgtgggaggcaccttnagcagctatgctatcagctgggtgcgacgaggccccgtggaccgaagggccttggagtggagtgggagggngtcaagtccctattcgttaggtatacgactaaacctacgcactaagtacgttacccgaggggcctaaggtacgtaccgtaaccggtacgtttaacccgggacccggtaacgaaaaccgttcccgaacgggtaacgacccggaaacctaccgggtaaccccttaacgtaacgttaaggggaccgtaccgttacgggaaacgtccggaacgacccggttaggaacgtacgttaccgtacggaacgggtaaccgaccgggtacccgtttaggttacgttacgttacggtacggtaccggtaagacggtaacttacggacggtaggttaccggtttaagttaccgttaggttacccggg

SEQ ID NO: 173414 - DNA, 558 bp, Homo sapiens
  misc_feature: GYAE6OF02H0OQJ.48.79.H02.1.454.CMB.1.raw
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgaaggtctcctgcaaggcttcgtggaggcaccttcagcagctatgctatcagtctgggtgcgacacggccccgtggacaggcttgagtggagtgggaggatcgactccctaagtccgtttaggtactagactaaactacgacaacgagtaacgttccgaggcagagtacacgtacttaacgcgaacaatccgaacgacgcacacgcctacagtggancgngagcgagccgtagacgacttcgtaggacggacgaccgggtccgttagttaacgttacgtggtacgacggagtacgtatacgaaggtagtttacggttaattacgtacgttaccggg

SEQ ID NO: 173415 - DNA, 667 bp, Homo sapiens
  misc_feature: GYAE6OF02JEGCQ.48.79.H02.1.454.CMB.1.raw
  modified_base (626)..(626): a, c, t, g, unknown or other
  misc_feature (626)..(626): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaaggtctccgtgcaagggtcttcgtgggacggcctaccgtttcgagaccgaaggtcctaagtcggtaccttaagtccgaaggtccgttggggtcaccggacgtaccgggcccccgttgggaaccgaaggggtcctttggaaggtgggtaagtggggtacgggaattcgaacggtcccttaagttccgttttgtacgtacgaaccgtaaacttaccggacacgtaagggtaacgttcccgaagggccgtaaggacgttaccgacggtactaacccgggcgtaaactaaacgtacccgacgggactaccaacggaccgtacgtaatagggtacgagtacgaggaacacgaaccgttcgcggaaactgttacgacggacgtacggcgtcgtagttaactcggtgngcgtaagctagtcgaagtgttagttactacggtcttacggg

SEQ ID NO: 173416 - DNA, 606 bp, Homo sapiens
  misc_feature: GYAE6OF02JCEVO.48.79.H02.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (330)..(330): a, c, t, g, unknown or other
  misc_feature (330)..(330): n is a, c, g, or t
  modified_base (492)..(492): a, c, t, g, unknown or other
  misc_feature (492)..(492): n is a, c, g, or t
  modified_base (556)..(556): a, c, t, g, unknown or other
  misc_feature (556)..(556): n is a, c, g, or t
tcagagtatacatacacgaccggtgctcgatttagtgtcacacgaagggaaaggggatcacataacaaccacattcctcctctaaagaagtccctgggagcacagctcatcaccatggactggacctggaggttcctctttgtggtggcagcagctacaggtgtccagtcccaggtgcagctggtgcagtctgggctgaggtgaagaagcctgggtcctggtgaaggtctcctgcaaggcttcgtggaggcaccttcgagcagctatcgctancagcgtgggtgacgacncggcccgtggaacgaagggtctggagtggagtggggaggntccgtactcccttagttcgtttaggtaatacgaactaaacgtacgctaacgaaggtaacgttccggaagggacaggtacgtcaacggtacttaccggaacggaaaccaaagtcccgaacggtacaaccacgaccgccgtaacacgttgggactacgtagacncgacgtcctaggataacgtcgtaggaacgacgacggtccttagttaacgtcgttggagtacggngaagtacgttacgaaggttaccggttaagttaccttacgtcggttaccgg

SEQ ID NO: 173417 - DNA, 677 bp, Homo sapiens
  misc_feature: GYAE6OF02HFY7X.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagagcctgggtcctcggtgaaggtctcctgcaaggcttcgtggaggcaccttcagcagttatgctatcagcgtgggtgcgacgacggccccgtggacgaagggtcttggagtggagtggggaggactcgactcctattcgttggtaatagactaaacgtacgacacgtaagtaacgttccgaagggtacaggtacgtaaccgtaaccggtaacgtttaacccgggaaccggtaaacgtaaaaccgttcccgaaacggacgtacccaaaccggaccgtacccttaacgacggttacggaacgtcgtacggaacgaccgtaacggtccctaggaacgtacgttaccgagggtaacggacccgtacggggacccgttagttacgttacgtcgggtacgtaccggaaggtacgtaacgtcggaaggttacgtttagggtttaactttaccggttccggttaccgggtttaacggg

SEQ ID NO: 173418 - DNA, 649 bp, Homo sapiens
  misc_feature: GYAE6OF02G9N3N.48.79.H02.1.454.CMB.1.raw
  modified_base (621)..(621): a, c, t, g, unknown or other
  misc_feature (621)..(621): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagccgtgggtccgtcggtgaaggtctcctgcaaggtcttcgtggaggcaccttcagcagctatgacttatcagtcgtggggtcgacgacgacggccccgtggaacgaacgggccttggaggttagggaggtcggggagggtatcgtacttcccgttaatttccgttttaggttaatacgtaacctaaaacgtaccgacgtaacgaacgtaacggtttaccgaggggacgtaaggtacgtaccgtaaccggtaactttaaccccgggaccggtaaacctaaaacgtacccgaacggaccgaacgaccgtaccgacctactaacggtggactcgtagacggtaccgacgtcgtagacgtactacgacggacgacgtacggcgttagttacgttcgtgtcgagtaacgagtcgacgnggtagttaggttattactcgttaccggg

SEQ ID NO: 173419 - DNA, 582 bp, Homo sapiens
  misc_feature: GYAE6OF02FKZGA.48.79.H02.1.454.CMB.1.raw
  modified_base (451)..(451): a, c, t, g, unknown or other
  misc_feature (451)..(451): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctcttgtggtggcagcagctacaggtgtccagtcccaggtgcagctggtgcagtctggggctgaggtgaagagcctgggtcctcggtgaaggtctcctgcaaggcttcgtggacggcaccttcagcagtctatgctatcagcgtgggtgcgacgacgggccccctaggacgaagggtctggagtgggagtggggaggtatcacttccgtattcgttggtatacgacaaactcgacacgagtacgttcgacggcagagacgtacgacgtaccgacgaaccaagtccacgacgaccacgactccaacacgtacggacncgtacggacgaccgacgcctaggacgtacgtacgtacgggacgaccggacggccggtttagtacgttacgtcggtcggacggaagacggtactacggagttagtttggttaacttcgttaccgttaccggg

SEQ ID NO: 173420 - DNA, 602 bp, Homo sapiens
  misc_feature: GYAE6OF02HC1US.48.79.H02.1.454.CMB.1.raw
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagagcctgggtcctcggtgaggtctcctgcaaggcttcgtggacggccaccttcagcagctatgctatcagcgtgggtgcgacacggcccctggacgaacgggcttaggagtggagtggggagggatccgatcccttattcgttggtatagaccaaactacgacacagtaagtccgaggcagacgtcgacgtacttaccggacgacaaacgtccacgancacacgacctanagtggagcgaggacncgacggcctaggacgtacgtacgtcgggaacggaccgtacggggtcccgttagttaacgtttaccggtcggttaggacccggtaaggtaacggtacgtacggtaacggtagggtttcggtttaagttttaccgttccggtttaacccgggg

SEQ ID NO: 173421 - DNA, 641 bp, Homo sapiens
  misc_feature: GYAE6OF02HXHF7.48.79.H02.1.454.CMB.1.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
tcagagtatacatacacgaccggtgctcgatttagtgtcacacgaagggaaaggggatcacataacaaccacattcctcctctaaagaagccccctgggagcacagctcatcaccatggactggacctggaggttcctctttgtggtggcagcagctacgaggtgtccagtccccaggtgcagctggtgcagtcgtgggctgaggtagaagagccgtgggtccgtggtcgaaggtctcctgacgaagtcttcgtaggaggccaccttcagacgacgtactangactatcaggcgtgggngtacgacgaccggtccccgaggacgaacggtcgtaggagtggtagtgggaggtataccgactcctatcgttaggtatagtacaaactacgacacgagtaacggtacaggtacgagtacgtactaacgtaacgttacccggaagtaactaacgaccgtaacgacgtacaccgtaacggacccttaagcgtacgggaacgtccgtaaggacgactaccggctaggaaccgcgttaccgtagggtaaaccggaccgtaacggggtcctttagtaacgtttacgcggttaggacggaagtacgagtacgagggttaacggttagtttaattaccggtccgtaacgg

SEQ ID NO: 173422 - DNA, 653 bp, Homo sapiens
  misc_feature: GYAE6OF02GHZE1.48.79.H02.1.454.CMB.1.raw
  modified_base (184)..(184): a, c, t, g, unknown or other
  misc_feature (184)..(184): n is a, c, g, or t
  modified_base (191)..(191): a, c, t, g, unknown or other
  misc_feature (191)..(191): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (376)..(376): a, c, t, g, unknown or other
  misc_feature (376)..(376): n is a, c, g, or t
tcagagtatacatacacgaccggtgctcgatttagtgtcacacgaagggaaagggatcacataacaaccacattcctcctctaaagaacgccctgggagcacagctcatcacatggactggacctggagttcctctttgtggtggcagcagctacgaggtgtccagtccgagtgcagcgtggtncagtcgngggctggagtgaagagccgtgggtcctggtgaagtcncngacagcttcgngacgtcacttcagcagtctagtcgcctagtcgagtcgtgggtcacgacgtaccggccgtagggacgaaggtcttaggagttcggagtgggaggtctcacttcccgttattcgttaggactagaactaacgttcgnaaacgttaggaaaccgttacgggacggtacaaggttccaaacgtaccgtaacggtacccgacggtaaacgtaacgttaccgacgtaacgaccgaacgtaccgtaccttaacggaagtccggtaacgctaaccgggagacgaacgttccgtagaacgttacgttgaaccggtacgaaccggtaccggagtttacgtacggtttacgtgggaccgacggtaacgtaacgtacgtacggtacgggtttacgtagtttaacgtcgttacccgggtttaggg

SEQ ID NO: 173423 - DNA, 672 bp, Homo sapiens
  misc_feature: GYAE6OF02FPBQ4.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctggaggtgaagaagccgtgggtcctcggtgaaggtcctcctgcaaggcttcgtggacggctaccttcagtcgacgctagtgctatcagtcgtgggtcgacgacgcggccccgtaggaccgagggcttggacggtggagtgggaggactaccatcccgttattcgttagtaatacgaacgtaactacgacacgtaagtaagttaccgaggtacgtagacgtacgtaacgacgttaaccggcgaaactaacgtaccgaacgacgtaccgaaccgtacgtaaccctacgtagtacggacgtccgtaaggcgaccgtacggtaccgtagaacggtcgttaccgtaagggacccggtaaccgtacgggtacccgttaggttaactttaccggttacggccggttaaacggacggttaacgtacgttacggtaagggtttacggttaacgtttaacgttttaccggtcggtttaaacccggg

SEQ ID NO: 173424 - DNA, 771 bp, Homo sapiens
  misc_feature: GYAE6OF02FHIKN.48.79.H02.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (252)..(252): a, c, t, g, unknown or other
  misc_feature (252)..(252): n is a, c, g, or t
  modified_base (556)..(556): a, c, t, g, unknown or other
  misc_feature (556)..(556): n is a, c, g, or t
tcagagtatacatacacgaccggtgctcgatttagtgtcacacgaagggaaggggatcacataacaaccacattcctcctctaaagaacgcccctgggagcactagctcatcaccatgactggacctggacgttcctcttgtggtgcagcagctacaggtctccagtcccaggtncacgcgtggtnacagtcgtggggctggagtgaagacgccgtcgggtcctcggtgacgtctccgtgcgaggtcttcgnggacggctaccttcgacgcgacgtctagttgccgtataccaggtcgtcggttacgcgacgtcggccccttagggaacctacgggtctttaggacgtagggtagtacggggacggtattacccaaaccgttttcccgtaacgttttacggtttacggtaacgtaaccggtaacccaaacgtttaacccggctaaacccggaaggttacccgtttccggaacgggaccttaacggtaccgtaccgtaacgggtacccgtttaacccggggaacctaaacctaaccgttacccgaaaccggggttanaaccccgaccgttaccgtaccccgtaaaggttcgacgggtaaccgttacggttaccgggaagtccgtaaccggcccggttaaagtacgtaaccggttcgtaaacggacccgggacggtttacccggtccctttagggaacctttaccggtgttcggaaaccggtgaaacgttcgtacggttacgagtttaccgtacgttacgttccgttaacggg

SEQ ID NO: 173425 - DNA, 700 bp, Homo sapiens
  misc_feature: GYAE6OF02G6XDY.48.79.H02.1.454.CMB.1.raw
  modified_base (535)..(535): a, c, t, g, unknown or other
  misc_feature (535)..(535): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctgggaggttcctctttgtggtggcagcagctacaggtgtccagtcccaggtgcagcgtggtgcagtcgtggggctggaggtgaagagccgtgggtccgtcggtgaaggtctcctgcacggtcttcgtgggacggctaccttcgagcacgctatcgctagtcacgcgttgggtcgacgaccggtccggccccgtgggacgaacgggtcttaggaggtggaggtagggggaggtacgtactaccgttaccgtttagtttaccggtttaggtacgtaacgtaacctaaacctacgaccgtaacgtaacgttaacggttcccggaaagggtccaaggtaccgtaccgaacgtacggttaacccggaacgaaaccgtaacgaacccgaacgacgaccaacgaccgcctaagagnggactacggcggacgcgaccgtacgtacggatacgttacgaaggtaccggtacgtacccgggtagttacgttacggttaacgcggtaccggacggtaaaggaacgttacggtacgtaagggtttaggttacggttttaacgtttaccgttcggtttaacccgggg

SEQ ID NO: 173426 - DNA, 843 bp, Homo sapiens
  misc_feature: GYAE6OF02HRY5D.48.79.H02.1.454.CMB.1.raw
tcagagtatacatacacgaccggtgctcgatttagtgtcacacgaaggggaaaggggatcacataacaaccacattcctcctctaaagaagcccctgggagcacagctcatcaccatggactggacctggacggttcctctttgtggtggcagcagctacaggtgtccagtcccaggtcgcagctggtgcaggtcgtggggctaggaggtgaaggaacgccgtggggtcctcgggtaggaacggttctctagcgaagtcttcgtggagcctaccttcgagacgagcgtaactggtactaactcaaggtcgtacgggtcgaccggtaccaccggtcccccgtaggtaccggaacggtccgtttaggaggttgggtaacggtggggaaggtataccggtaactcccgttagtacgtttttcgggtaatacgtacaaaacgttaccgtacgaacgtaacggttaaaccggttaccggaaacggggccgtaagggtaaccggttacgtaaaccggtaacgtttaaccccggggaaccggtaaacctaaaaccgttaccgaaacgaccggaacctaacccggaaacgtaccccgtttaagaaccgttagggaacggtacctagggaacggtaccgaaccggttaccgtacgggaagttaacccggttaccgtaacgggtaaccgggtaacgggtaacccgggttacccgggtttaaggtttaaccttacgggtttacgggacgggtttaacccggacggggaaagtttaacggtacggtaacgggtttaggtttaaacccgggttttttaacggtttaccgtttcccccgggttttaaacccgggggg

SEQ ID NO: 173427 - DNA, 794 bp, Homo sapiens
  misc_feature: GYAE6OF02FIEIA.48.79.H02.1.454.CMB.1.raw
  modified_base (186)..(186): a, c, t, g, unknown or other
  misc_feature (186)..(186): n is a, c, g, or t
tcagagtatacatacacgaccggtgctcgatttagtgtcacacgaagggaaggggatcacataacaaccacattcctcctctaaagaacgcccctgggagcacagctcatcaccatggactggacctggacggttcctcttgtggtgcagcagctacaggtcgtccagtcccaggtgcagctggtncagtcgtggggctggacggtgaagaacgcctggggtccctcgggtagaacggtcctccgtcgacgtaacggtcctttcgtagggaccggtcctaacccttcgaacggccaacggtcctacttacggtacctacttccgaacggtcgtcggtcggaccgaacgacggtcccccgttagggaaccgtaaacgggtctttacgggaacggtcgggtaacggttagggggacgggtaaccttacggaaccgttcccccttaaaggtttcccgttttacgggaaacttaaccggtaaccctaaaaccgtaccgtaaccaacgtaacggttaaaccggttacccggacgggtaccaacgggtacgtaaccgtaacccggacggtttaaccccgaaccgggaaacctaaacccgttacccgaacgggtaaccacccgaaccgaaccggttaccctaacggtacgttacgggtaccgtaccgttacgggaaccgaccgtacggtacccgttagggaactaaccgttcgtaacggaacggaccgtaccgtcgttacgtacttacggtcgtacgacgatacggattaccgagtacgttcgtacttacgtccggtacgg

SEQ ID NO: 173428 - DNA, 818 bp, Homo sapiens
  misc_feature: GYAE6OF02JPST2.48.79.H02.1.454.CMB.1.raw
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
tcagagtatacatacacgaccggtgctcgatttagtgtcacacgaagggaaaggggagtcacataacaaccacattcctcctctaaagaagcccctgggagcacagctcatcaccatggactggacctggacggttcctcttggtggtggcagcagctacgaggtcgtccagtcccaggtcgcagctggtgcagtcgtgggctggagtcgaagacgtcctgggtacctcgggtnaacggtctccgnggtaccgaacggtcgttacggtcggacgccgtaacccgtttcgaacggtccaaggtacttacgtcggtacgttaactcggtaacggtcggtacggggtcgtaccgggaaccgtacggggtacccccgtagggaaccgtaacggggtccgttaggaggtacgggtaacggtggggacgggtaacgtccgtacgtacccgtagttccgttaaggttacgtacggtaacctaaacgtcgaccgtaacgtaacgtaacggttcccgagggtaccgtaagtacgtaaccgtaacgtccgttaaccggtacggtaacaaacgttccggaagtaaccgaccgtacgaccgttaccgtaacgtaacggtaacggccgtaacgtcgggtaacgtaccgtaccgtaccgtaacgaggtccgttaacgggtaaggtacccggtaacgggtacccgttacggttaccgttaacgggtttccaaacggggtttccggtaacggtaccgttaacgggtaaacgttacccgggagtttaaccgggttaacggtttaaccggtttaacccttaccgggtttacccggg

SEQ ID NO: 173429 - DNA, 668 bp, Homo sapiens
  misc_feature: GYAE6OF02IBTNN.48.79.H02.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggacggttcctctttgtggtggcagcagctacgaggtcgtccgagtcccaggtgcagcgtggtgctagtcgtgggntggaggtagaagagccgtgggtcctacggtgacggtcnccgtgacgaaggtctcgtggacgctacctgacgcagtctagttacgcttanacgngtcgtagggcgacgacgcccggtccgtagggaaccgtaagggtccttaagggcgtttagggaggttagggggaacgggtactacgtaaccgtttccgttaggttcggtttaggtaacgtacgtaacctaaaccggtcgaactaacgtaacggtacgtacgggacgacgagacgtactaaccggtaacgtacggaacgtaaccgaaacgtccgacgtaacacgaacgacaaccgtagacgtgacgtactacgggaacgccgagtaccgagtaacgatacgacggacggtcgtaaccggtacgtcgttattaggtaacgtcggagaacggaagtcgaagtacggttagttcggtttaaactcgttacgtaccgg

SEQ ID NO: 173430 - DNA, 655 bp, Homo sapiens
  misc_feature: GYAE6OF02HF02M.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcgggtgaaggtctcctgcaaggcttcgtggaggcaccttcagcagctaatgctatcagctgggtgtcgacgacggccccgtaggaccgaagggccttaggagtggagtgggagggatacgatccctatcgtttaggatacgactaaacgtacgacacaagaacgttccgaggaccaggtacgtcgaacgtacgttaaccggacggaacaaacgtccgaaacgtacgacctaacacggtaccctaacgacgtacggagacgtggaacgtccgaacgtccgttagaacggtactaccgttaaggaaccgggtaaccgtaccggggtacccgttaggttaacgtttaacccggtggttaccggtaccggtaaaggaacggtaattaccgggaaagtagggtttaacgggtttaactttacggtaccgtttacccgggg

SEQ ID NO: 173431 - DNA, 609 bp, Homo sapiens
  misc_feature: GYAE6OF02HJ1YV.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagcctgggtcctcggtgaaggtctcctgcgaaggcttcgtggagcaccttcagcagctatgctatcagtcgtgggtgacgacgacggccccgtggacgaagggtcttaggaggtaggagtggggacggtatcactccgttagttcgtttaggtataacgaccgtaaactcgactacgaagtacgttaccgaggcgagacgtacaacgtacgttaaccggaccggaacaaaccgtccgacggaacaccgaacgacgaccctacgagtacgagtctgagccgacgcgtagagtactccgaggacggacgaccgggtctaggttattaccggtggtacggacgtaaggacgtaataccggtaaggtacggtttaggttaaccgtttacgttggttaacccggg

SEQ ID NO: 173432 - DNA, 685 bp, Homo sapiens
  misc_feature: GYAE6OF02JX5KZ.48.79.H02.1.454.CMB.1.raw
  modified_base (168)..(168): a, c, t, g, unknown or other
  misc_feature (168)..(168): n is a, c, g, or t
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (514)..(514): a, c, t, g, unknown or other
  misc_feature (514)..(514): n is a, c, g, or t
  modified_base (576)..(576): a, c, t, g, unknown or other
  misc_feature (576)..(576): n is a, c, g, or t
  modified_base (629)..(629): a, c, t, g, unknown or other
  misc_feature (629)..(629): n is a, c, g, or t
tcagagtatacatacacgaccggtgctcgatttagtgtcacacgaagggaaaggggatcacataacaaccacattcctcctctaaagaagcccctgggagcacagctcatcacatggactggacctggacggttccttctttggtggtggccaggcagtctagaggtntccagtcccgagggtcgacgngcgtgggtgcagtcgtggggctggaggtgaagaaggtccgtgggttccgcggtagtacgtctacgngacgagtcttcgaggacgcgccttanacggcacgtactactcgactntcgagtcggttggacggtacgacgtaccgaccgtacggaacgtacgggngttcggaagtgggagtagggaggtacgtacnccttaccgtagttacgttacggtaacgtagtaaccgtaacgtacgactaagaacgttaggtaccggaggtacctaaggacggtaacgacggtaacgttacccgacggaaaactaccgaccgtaggaccctanaaccgccgttacctacgtaggtaacggcgtagtacgacggtcgtaacgtacggtagtaccgntaacggtcggaacgtaaacgcccgggtgttacgaattcgggtgaaacggtcgngggaacttacgtaggttaccggtagtttaacgtaggttccgttaccggttaaccgg

SEQ ID NO: 173433 - DNA, 831 bp, Homo sapiens
  misc_feature: GYAE6OF02ISHOR.48.79.H02.1.454.CMB.1.raw
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtcgtccagtcccaggtgcagctggtgcagtctgggctgaggtgaagaagcctgggtcctcggtgaaggtctcctgcaggcttcnggngcacttnagcagctagtgctatcagtcgtgggtcacgaccgtacggtccccgtaggaacgtaacggggtcttaggaacggtacgggaagtagggggaacgggtacttaccgtaacgttccccgttagtttaccgtttaggggtaacctaacgggtaaccctaaaaaccgttacggacccgtaaacggtaacggtaaaacggttcccgggaaaggggtacccgtaaaggtacccggtaacctaaacccggtaaacgttaccccgggaacggtaaacccgaaaacttcccgaacgtaccgacccaaccgaccggttaacctaccggtaaggttacgggaaaccgtccggtaaggacccggaccgtaacccgggtaccgtaagggtaaccggttaacgttaccggttaaacgggaacccggggttaacccgaccgggggttttaccgtttaaggttttaacccggttttaaccgggtgggtttaacccggaaccgggtaaagaaccgggtttacgaaccggtttaacggggtttaagggttaacgttttaaacgtttaacccggttccggtttaaacccccggggg

SEQ ID NO: 173434 - DNA, 728 bp, Homo sapiens
  misc_feature: GYAE6OF02FQ9IJ.48.79.H02.1.454.CMB.1.raw
tcagagtatacatacacgaccggtgctcgatttagtgtcacacgaagggaaaggggatcgacataacaaccacattcctcctctaaagaagcccctgggagcacagctcatcaccatggactggacctggaggttcctctttgtggtggcagcagctacaggtgtccagtcccaggtgcagcgtggtgcagtcgtggggctggaggtcgaaaggagccgtacgggtcctcgggtgtaacggtcctcctggactaagggtactttcgtagggacggacctaaccgttcgaacgccgtaagtcgttagtcgtacttactcgaacgtcggttgggtacgtacgaccgtacgggtcccccgtagggaaccgaacgggtcgttaggacggtagggtacggttgggggacgggtactaccgtacgttaccccgttagtttacggtttacggtaatacggtaaccaaaacgtcgactaaccgtaagtaacgttacggaggtacgagtacgacgtagtaccgtaccggaacggaacctaacaccgaacgacaaccgacgaaccgtacctaacgtacgtcgggacgtccgtagaccggtctaccgccggtagacggtccttagaaggaccggtacgacccggttcggtattacgttaccggtgggtaccgaggtaacgaagtcgtaccggtaaggttacggtttaggttaacgtttcccgttagggttaacccgggg

SEQ ID NO: 173435 - DNA, 702 bp, Homo sapiens
  misc_feature: GYAE6OF02I17NR.48.79.H02.1.454.CMB.1.raw
  modified_base (184)..(185): a, c, t, g, unknown or other
  misc_feature (184)..(185): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (629)..(629): a, c, t, g, unknown or other
  misc_feature (629)..(629): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggagttcctctttgtggtggcagcagctacaggtgtccagtcccaggtgcagctggtnnagtcgtgggctggaggtagaagacgtccgtgggtccctcggtagaaggttcctccgtagaccgtaacggtcttcgtgggacggccaaccttcgagcagctatgacgtancagcgtggtcgcgacncggtccctaggacgtacggcttagacgtgagtcgggagctcactacccttagttcgttagtaactacggaactaaacgtacgactaacgaagtaacgttcgaacgggtctaacggtacttacgaaccgtacgttaaccccggaacggtaaaccaaaccgttacccgaacggtaacgacccgaacgtaaccggtaccgtaacgtaacggttacggtaaccggtacgtacggtaccggtaacacgggttaccccgtaggtaaccgtacgttaccgttaccggaacggtaaccgaccgggtaccgttagtacgtttaacggnggttaccgaacgtaagtacggtaactacgggaacgttaaggttcggtttaacgttacgtacccgttaaccggg

SEQ ID NO: 173436 - DNA, 673 bp, Homo sapiens
  misc_feature: GYAE6OF02GV520.48.79.H02.1.454.CMB.1.raw
  modified_base (240)..(240): a, c, t, g, unknown or other
  misc_feature (240)..(240): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagagcctgggtcctggtgagtctcctgcagcttcgnggagcaccttcagtcagctatgctatcagcgtgggtgcgacgacggcccctgggacgaagggcttggaggtggagtgggaggtatacgactacccttagttcgtttggtatacgtacctaaacgtacgacgaaccgtaagtaacgttaccgagggtaccaaggtacgtaccgaacgtaccgttaaccggaccggaactaaacgtaccgaacgaacgtaccaacgtacgtacccgtaagtacgtaacgggacgtacgtaagaccggaacgtaccggtacgtacgaacgtacgtaccgtagggaaccggtaaccgaccgggttaccgggtatttaacggttacgttaggtaccgggtacggtaaggtaaccggtagttaaccggaaggggtttacgttttagggtttaagtttacccgttcggtttaaccccggg

SEQ ID NO: 173437 - DNA, 726 bp, Homo sapiens
  misc_feature: GYAE6OF02H4VAK.48.79.H02.1.454.CMB.1.raw
  modified_base (247)..(247): a, c, t, g, unknown or other
  misc_feature (247)..(247): n is a, c, g, or t
tcagagtatacatacacgaccggtgctcgatttagtgtcacacgaagggaaaggggatcacataacaaccacattcctcctctaaagaagccccctgggagcacagctcatcaccatggactggacctggaggttcctctttgtggtggcagcagctacaggtgtccagtcccaggtgcagctggtgcagtcgtgggctgaggtgaagacgccgtgggtcctcggtgagtctctgcgaggtcttcgnggacgcctaccttcagcacgctatgctatctagcgtgggtcgcgaacgaccggtccccgtaggaacggaacgggtcttaggacggtggaggtggggaagggatccgtactcccttatccgttttaggtatacggtaaccaaacgtacggacaacgtaacgtaacgttccgagggtaccgaaggtaccgtacgtaaccgtaacgttacccggaccggtaaaacaacccgttaccgaaccggtacgaccaaccgtaaccgaacccgttaacaacggttacgggaccgtcgtaacgggacgaaccgtacggtacccgagttaaccggactttacgggtacgggaaaccggtacccggtaacgggttacccgtttaacggttaccgtttaaccgtgggtaacggtaccggtaacgtacgaccgttacggtaacgggttagttttaacgggtttaacctttacggttccggtttaaccccgggg

SEQ ID NO: 173438 - DNA, 651 bp, Homo sapiens
  misc_feature: GYAE6OF02GPGMK.48.79.H02.1.454.CMB.1.raw
tcagagtatacatacacgaccggtgctcgatttagtgtcacacgaaggaaaggggatcacataacaaccacattcctcctctaaagaagcccctgggagcacagctcatcaccatggactggacctggaggttcctctttggtggtggcagcagctacaggtgtccagtcccaggtgcagctggtgcagtcgtggggctggaggtgaagagccgtgggtcctcgggtgaggtctccgtgcgaaggtcttcgtgggacgctaccgttcagcagctagtgactatcgagtcgtgggtcgacgacgacggcccgtaggaccgaagggtcttaggacggtggaggtggggaggtactacacttccctagttctttaggtaatagacctaaacgtcgacaacgtaaggtaacgttaccggagggtacacggtacgacgtaacgtacggtaaccggaccgaactaaccgtaccgacgacgacgaactcggaaccgtacgaggtggacgtcgtacggacgcgaaccggtactggagtacgtactagggaaccgcggtaccgggacgtttacgttacgttacgtcggtaggaccggtaaggtaacgtaaggtacggtaggttaaggttacggttttaattccgtacggtttacccgggg

SEQ ID NO: 173439 - DNA, 846 bp, Homo sapiens
  misc_feature: GYAE6OF02HAM43.48.79.H02.1.454.CMB.1.raw
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacgaggtcgtccagtcccaggtgcagtcgtggtcgcagtcgtggggcgtaggagggtagaaaggtaacggtccgtcggggttcccgttacgggtaggtaaacggttccgtaccgtggacgtaacggttcgttacggtacgggacggtaccctacccgtttcgacggtaccgagtacctaagttcggtacttacgtacgacggtccggttaggggtaccgtaccggaccggtaccgggacccccggttagggtaaccgggaacgggttccgtttaggaacgggttcggggtaagggttcgggggtaacgggtaactccgtaaccgtttacccgttagttttacggttaggtaaaaccgtacggaaccttaaaccgtacgaaccacggtaaacggttaccgtaccggaaggtccgtaaaggtactaccgtaccgtacgttaaaccgggaaccgtaaacgtaaaccgtacgaaacggtaaccgaccgtacccgaaggtaccctacgtacggtcgaacgttcgacggacgtacccgacgttacggacaacggttacgtcgttaacgggacgtaaccccgggtagggttacccgttacgttaagtttacccggtgggtacccggtaggaacgtaaggttcccgtaagggtacgggttaggtttaaccgttacgttttaccgtacccgggttaggg

SEQ ID NO: 173440 - DNA, 623 bp, Homo sapiens
  misc_feature: GYAE6OF02FPO7N.48.79.H02.1.454.CMB.1.raw
  modified_base (485)..(485): a, c, t, g, unknown or other
  misc_feature (485)..(485): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttccctctttggtggtggcagcagctacaggtgtccagtcccaggtgcagctggtgcagtctggggctgaggtgaagagtccttgggtcctcgggtgaaggtctccgtgcaaggcttcgtggacggctaccgttcagcagtctatgctatcagtcgtggtgcgacgacggccccgtggaacagggctcgaggtggagtgggagggatcgactccctatcgtttaggtatacgactaaaccgtcgacacgaacgtaacgttccgagggccaaggacgtacgaacgtacttaccccggacggtaaccaaacgtcccgacggacaccgaaccacggtacctaacgacgtagggacncgtacgacgaccgagacccgtagacgtacgtcgtacggaacgaaccgaccgtccggttagtacgttaccgtcggtacgaccgaagtacgtaactacggacggttaagttacggtttaacttaccgttcggttaaccgg

SEQ ID NO: 173441 - DNA, 593 bp, Homo sapiens
  misc_feature: GYAE6OF02IZBHJ.48.79.H02.1.454.CMB.1.raw
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (455)..(455): a, c, t, g, unknown or other
  misc_feature (455)..(455): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (550)..(550): a, c, t, g, unknown or other
  misc_feature (550)..(550): n is a, c, g, or t
  modified_base (558)..(558): a, c, t, g, unknown or other
  misc_feature (558)..(558): n is a, c, g, or t
tcagagtatacatacacgaccggtgctcgatttagtgtcacacgaagggaaagggatcacataacaaccacattcctcctctaaagaagcccctgggagcacagctcatcaccatggactggacctggacgttcctctttgtggtgcagcagctacgaggtgtccacgtcccaggtgcgacgcgttcggtgcgtagtcgtgggctgaggtagaagagccgtggtccgtggtagacgtctcgtgctaacggtcttacgnggacgctaccgtgacgaccgtacgtactagtgcttancgagcgtaggtcgcgtacgcgtccgtagggacgacggtctaggagtggaggtggaggactctactcctagttcgttagtacacgacctaacgacacaacgagtacgtacggacggcgagtacgtacacgttacgtaccgacggtaacaacgcgtaacggntaccgacctagcctacgtaggngaccgtgacgacgnacggtcgtnacgtagtccgagacgtacggccgttagtgttacgtcgtggtaccgaaagngtaaccgngtcgtaggttacgttgtaacgttctcggtaaccgg

SEQ ID NO: 173442 - DNA, 847 bp, Homo sapiens
  misc_feature: GYAE6OF02HDH2J.48.79.H02.1.454.CMB.1.raw
  modified_base (821)..(821): a, c, t, g, unknown or other
  misc_feature (821)..(821): n is a, c, g, or t
tcagagtatacatacacgaccggtgctcgatttagtgtcacacgaagggaaaggggatcacataacaaccacattcctcctctaaagaagcccctgggagcacagctcatcacatggactggacctggagttcctctttgtggtgcagcagctacaggtcgtccagtcccaggtgcagcgtggtgcagtcgtgggctggaggtgaaagacgtccgtgggtccttcgggtacggaacggttccttaccgtggacgtaacggtcctttcggtaacgggcggtacctaacccgtttcgaacgccgaacggtcttagttcggcctaagttccgtacgggtccgttgggggttccgaccggacccgacccggggttcccccgttaagggaccgtaacggggttccgtttagggtaagggttcgggaagggtaggggggtagggtaccttacgtaccgtttacccgtaagttttcccggttttaggaaacgttaccgggttaaccaaaaaccgtttccggaacgttaaaccgtaaagggtaaaccggttttcccgggaagggtaaccgaagggttacctaacccggaccggtaaaccgttcccggggtaaaccgaaaccgttaaacccgttccggaacggtaaggaaccctacggaaccttaccgtaaggaaacgttgggaaactttcggacggtcctaaccggcgtaacccgtataacggtcttaaccgggacgggaacgttaaccccggtggttacgttaacccgtagtttaccggtcggtaccggaataaacgggcgttaagtccgtaggtaaaccgggttttnttttaacggtaccgttcggtaaccgg

SEQ ID NO: 173443 - DNA, 803 bp, Homo sapiens
  misc_feature: GYAE6OF02IP9HQ.48.79.H02.1.454.CMB.1.raw
  modified_base (310)..(310): a, c, t, g, unknown or other
  misc_feature (310)..(310): n is a, c, g, or t
  modified_base (656)..(656): a, c, t, g, unknown or other
  misc_feature (656)..(656): n is a, c, g, or t
tcagagtatacatacacgaccggtgctcgatttagtgtcacacgaagggaaaggggatcacataaacaaccacattcctcctctaaagaagccccctgggagcacagctcatcaccatggactggacctggaggttcctctttgtggtggcagcagctacgtaggtgtaccacgtcccgaggtgcagtctgggtgacgtagtcggtggggctggtaggttaggaaacgaagtccggtcgggtccgtcggtaggtacggtccttcgtagacgtaacggtcttacgtggtacgcctacctcagcagtctagngtactatcaggacgtgggtcgaccggtacggtcccggtaccggtaggacggaacggttcgtagggtagtgggaaggtggggtaaggtactacgttacctacttcgtttacgttaacgtagtaaacgtaaccgaaaacttaccacgtaaacctaaggggtaaccgtttaaccggacgggtaaacgacgggttacgtaacccggtaaacgttaaacgtaaccccgggtaaccggtaaacctaaacggtacccgtaaacgaaaccgaaccgtaacccgtaaccgggtaaccctacggtaggtttaagggaaccgttaggtacccgtaggtaacccgacggttaaaccgnggtaaagttccgtaccggaacgggttaaaccgacccggtaaccggtaacccggtttagtaccgttagggtacccgttacggacggtagttaacgacgggtacgtttaaggtaggtttatttttaccggtacggttccgggttaacgg

SEQ ID NO: 173444 - DNA, 715 bp, Homo sapiens
  misc_feature: GYAE6OF02HSZC9.48.79.H02.1.454.CMB.1.raw
tcagagtatacatacacgaccggtgctcgatttagtgtcacacgaagggaaagggatcacataacaaccacattcctcctctaaagaagcccctgggagcacagctcatcaccatggactggacctggaggttcctctttgtggtggcagcagctacaggtcgtccacgtcccgaggtcgcagtcgtggtgcgagttcgtgggtctggaggtgaagacgtccgtggtccgtcggtgaggtcctccgtgacgaacggtcttcgtgggacgcctaccttcgacgctagctagtcgtactactcgagtcggtggtcgacgaccgaccggcccgtaggaaccgtacggtcgtaggtacggtgggtaggtagggaacggtctaccgtaccttaccgttacgtttacgtttaggtaactaacgtaaccgtaaacgtacgtaaccgtaacgaacgttaaccgttaccggacgtaagacgtaacgtaccgaaccgttaaccggttaccggaaccgtaaaactaaccgtaaccgaaccggacgaacccgtaacgacccgtaacccgttagtaacggtccggaactcggtaggaccgccgtaacgtccggaaggtacttacgcggtaacgcccggaagttacgggtccttagtacgtttggacgtacgacggagtacgtagtcggtacgggttagttcgttaatttaccggtacgttaaccgggg

SEQ ID NO: 173445 - DNA, 756 bp, Homo sapiens
  misc_feature: GYAE6OF02F7W7C.48.79.H02.1.454.CMB.1.raw
  modified_base (187)..(187): a, c, t, g, unknown or other
  misc_feature (187)..(187): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctctttgtggtggcagcagctacaggtgtccagtcccaggtgcagctggtcncagtcgtgggctgaggtgaagaagccgtgggtcctcggtgtaacgtctccgtgacgacggtcttcgtggacgtcctaccgtcgagactacgtactagtcgtactacgtcgtacgtcggtgggtacgacggtaccggacccggtacccggtacgggaaccggtagggtcgttaggtacggtagggtagggtacggggtaacgtacgtaccgtaccgttaccgttacgttacggttagtaacgtaacgtaaccgtaaacgtaccgaacgtaaccgtaacgtaaccggtaccgggaacggtacgtaacggtaaccgtaaccgtaaccggtaaccggtaaccggaaacgtaaaccgtaaaccgtaccgaaacggaccgtaaccgtaaccgtaaccgtaaccgtacgaacggtacggacgtacgaacggacgaccgtacgtccgtaagtacgtacggtacgacggtaaccggtaccggtaccggttacgttacgttacgttacgggtcgtacggtaacggaagtaacgtagtacggtaggttacggttacttaacggttccggtacggttacgg

SEQ ID NO: 173446 - DNA, 647 bp, Homo sapiens
  misc_feature: GYAE6OF02FT9A2.48.79.H02.1.454.CMB.1.raw
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagagtatacatacacgaccggtgctcgatttagtgtcacacgaagggaaaggggatcacataacaaccacattcctcctctaaagaagcccctgggagcacagctcatcaccatggactggacctggaggttcctcttgtggtggcagcagctacaggtgtccagtcccaggtgcagctggtgcagtctggggctgaggtgaagaagcctgggtcctcggtgaaggtctacctgcaggcttcgnggnggcaccttnacgcagctatgctatcagtcgtggtcgcgacgacggtcccctaggacgaaggtcgttaggaggtggacgtgggacggtatcgactcctacgttcgtttaggtatacgtaactaaacgtacgccaacgacgtaacgttaccgagggtacagacgtacgaacgtacgttacccggacggaactaaactcccgaacggaagccaaccgacgacctaacgacgttacggacgtccgtagacgccgacgtaccgtagacgttacgtcgtacggaccggtaaccgtccgggtaccgttgttaaccgttaccggttggacggtaacggtaaggtaacgtacgtacgttaacgggttaggtttaacggtttacgttacgttccggtttaacccgggg

SEQ ID NO: 173447 - DNA, 158 bp, Homo sapiens
  misc_feature: GYAE6OF01CDTTF.46.45.E01.1.454.CMB.1.raw
  modified_base (153)..(158): a, c, t, g, unknown or other
  misc_feature (153)..(158): n is a, c, g, or t
tcagactagcagtacacgaccggtgctcgatttagtgagtcagtaagggaaagggaccaaggtggaaatcaaacgaactgtggctgcaccatctgtcttcatcttcccaccctcctctactgctagtctgagcgggctggcaaggcgcatagnnnnnn

SEQ ID NO: 173448 - DNA, 193 bp, Homo sapiens
  misc_feature: GYAE6OF01AKLW8.46.45.E01.1.454.CMB.1.raw
  modified_base (153)..(193): a, c, t, g, unknown or other
  misc_feature (153)..(193): n is a, c, g, or t
tcagactagcagtacacgaccggtgctcgatttagtgagtcagtaagggaaagggaccaaggtggaaatcaaacgaactgtggctgcaccatctgttttcatcttcccgccctcctctactgctagtctgagcgggctggcaaggcgcatagnnnnnnnnnnnnnnnnnnnnnnnnnnnnnnnnnnnnnnnnn

SEQ ID NO: 173449 - DNA, 193 bp, Homo sapiens
  misc_feature: GYAE6OF02IWGGH.46.45.E01.1.454.CMB.1.raw
  modified_base (153)..(193): a, c, t, g, unknown or other
  misc_feature (153)..(193): n is a, c, g, or t
tcagactagcagtacacgaccggtgctcgatttagtgagtcagtaagggaaagggaccaaggtggaaatcaaacgaactgtggctgcaccatctgtcttcatcttcccgccctcctctactgctagtctgagcgggctggcaaggcgcatagnnnnnnnnnnnnnnnnnnnnnnnnnnnnnnnnnnnnnnnnn

SEQ ID NO: 173450 - DNA, 152 bp, Homo sapiens
  misc_feature: GYAE6OF02GZO7H.46.45.E01.1.454.CMB.1.raw
  modified_base (152)..(152): a, c, t, g, unknown or other
  misc_feature (152)..(152): n is a, c, g, or t
tcagactagcagtacacgaccggtgctcgatttagtgagtcagtaagggaaagggaccaaggtggaaatcaaacgaactgtggctgcaccatctgtcttcatcttcccgccctccttactgctagtctgagcgggctggcaaggcgcatagn

SEQ ID NO: 173451 - DNA, 249 bp, Homo sapiens
  misc_feature: GYAE6OF01AWQFP.49.65.F10.1.454.CMB.1.raw
tcagagtcgagagacacgaccggtgctcgatttagctacgctctaaggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgcccctcggtcactctgttcccacctcctctctctcgactctgagcgggctggcaaggcgcatag

SEQ ID NO: 173452 - DNA, 252 bp, Homo sapiens
  misc_feature: GYAE6OF01CIBR1.49.65.F10.1.454.CMB.1.raw
  modified_base (252)..(252): a, c, t, g, unknown or other
  misc_feature (252)..(252): n is a, c, g, or t
tcagagtcgagagacacgaccggtgctcgatttagctacgctctaaggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagn

SEQ ID NO: 173453 - DNA, 256 bp, Homo sapiens
  misc_feature: GYAE6OF01B5ZT0.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacgacggccaccctgaccatcacgccagggtcgaagccgggatgaggccgactagttactgtcacgtgtggacagtagtagtgatcatgtggtgttcggcggagggaccaagctgaccgtcctaggtcagcccaaggctgccccctggtcactctgttcccgcctcctctctctcgactctgagcgggctggcaaggcgcatgnnnn

SEQ ID NO: 173454 - DNA, 253 bp, Homo sapiens
  misc_feature: GYAE6OF01ESEQ9.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagn

SEQ ID NO: 173455 - DNA, 258 bp, Homo sapiens
  misc_feature: GYAE6OF01DDPXL.49.65.F10.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnn

SEQ ID NO: 173456 - DNA, 255 bp, Homo sapiens
  misc_feature: GYAE6OF01C4D30.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnn

SEQ ID NO: 173457 - DNA, 253 bp, Homo sapiens
  misc_feature: GYAE6OF01DRY7B.49.65.F10.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccaccctcctctctctcgactctgagcgggctggcaaggcgcatagnn

SEQ ID NO: 173458 - DNA, 277 bp, Homo sapiens
  misc_feature: GYAE6OF01B8LXE.49.65.F10.1.454.CMB.1.raw
  modified_base (258)..(277): a, c, t, g, unknown or other
  misc_feature (258)..(277): n is a, c, g, or t
tcagagtcgagagacacgaccggtgctcgatttagctacgctctaagggacgtacgggccgaccctgaccatcagcagggtcgaagccgggatgaggccgactattacctgtcacgtcgtggacagtagtagtgatcatgtggtgttcggcggaggaccaagctgaccgtcctaggtcagcccaaggctgccccctggtccactctgttcccaccctcctctctctcgactctgagcgggctggcaaggcgacatagnnnnnnnnnnnnnnnnnnnn

SEQ ID NO: 173459 - DNA, 255 bp, Homo sapiens
  misc_feature: GYAE6OF01BMK2U.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173460 - DNA, 253 bp, Homo sapiens
  misc_feature: GYAE6OF01CWXKY.49.65.F10.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgctctaagggacacggccaccctgaccatcagcaggtcgaagccgggatgaggccgactattactgtcacgtgtgggacagtagtagtgatcatgtggtgttcggcggaggaccaagctgaccgtcctaggtcagcccaaggctgccccctggtcactctgttcccaccctcctctctctcgactctgagcgggctggcaaggcgcatagnnnn

SEQ ID NO: 173461 - DNA, 286 bp, Homo sapiens
  misc_feature: GYAE6OF01EUNBK.49.65.F10.1.454.CMB.1.raw
  modified_base (148)..(148): a, c, t, g, unknown or other
  misc_feature (148)..(148): n is a, c, g, or t
  modified_base (157)..(158): a, c, t, g, unknown or other
  misc_feature (157)..(158): n is a, c, g, or t
  modified_base (169)..(169): a, c, t, g, unknown or other
  misc_feature (169)..(169): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (258)..(286): a, c, t, g, unknown or other
  misc_feature (258)..(286): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgtcgcggnggacgacannacgcctcgtgnccaccgagtncccncccgtgacnctgtccgtaccccncctcctctctcgactactcgtagcggcggtcgtcgacgacggccataagtgnnnnnnnnnnnnnnnnnnnnnnnnnnnnn

SEQ ID NO: 173462 - DNA, 254 bp, Homo sapiens
  misc_feature: GYAE6OF01DW7EM.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnn

SEQ ID NO: 173463 - DNA, 254 bp, Homo sapiens
  misc_feature: GYAE6OF01ESJJ1.49.65.F10.1.454.CMB.1.raw
  modified_base (254)..(254): a, c, t, g, unknown or other
  misc_feature (254)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagn

SEQ ID NO: 173464 - DNA, 255 bp, Homo sapiens
  misc_feature: GYAE6OF01BZUBI.49.65.F10.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcggctggcaaggcgcatagnnnnn

SEQ ID NO: 173465 - DNA, 255 bp, Homo sapiens
  misc_feature: GYAE6OF01DN1H8.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173466 - DNA, 256 bp, Homo sapiens
  misc_feature: GYAE6OF01CHGB9.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 173467 - DNA, 273 bp, Homo sapiens
  misc_feature: GYAE6OF01CI27F.49.65.F10.1.454.CMB.1.raw
  modified_base (256)..(273): a, c, t, g, unknown or other
  misc_feature (256)..(273): n is a, c, g, or t
tcagagtcgagagacacgaccggtgctcgatttagctacgctctaagggacacggccaccctgaccatcagcagggtcgaagccggggatgtaggccgactattactgtcacggtgtgggacagtagtagtgatcatgtggtgttcggcggagggaccaagctgaccgtcctaggtcagcccaaggctgccccctggtcactctgttacccgccctcctctctctcgactctgagcgggctggcaaggcgcatagnnnnnnnnnnnnnnnnnn

SEQ ID NO: 173468 - DNA, 268 bp, Homo sapiens
  misc_feature: GYAE6OF01C2A0Q.49.65.F10.1.454.CMB.1.raw
  modified_base (262)..(268): a, c, t, g, unknown or other
  misc_feature (262)..(268): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgaggcggcgtcggacgaacggcgactatagnnnnnnn

SEQ ID NO: 173469 - DNA, 253 bp, Homo sapiens; identical to SEQ ID NO: 173454
  misc_feature: GYAE6OF01DRQP4.49.65.F10.1.454.CMB.1.raw
  modified_base (253)..(253): a, c, t, g, unknown or other
  misc_feature (253)..(253): n is a, c, g, or t

SEQ ID NO: 173470 - DNA, 255 bp, Homo sapiens; identical to SEQ ID NO: 173465
  misc_feature: GYAE6OF01DVXKV.49.65.F10.1.454.CMB.1.raw
  modified_base (254)..(255): a, c, t, g, unknown or other
  misc_feature (254)..(255): n is a, c, g, or t

SEQ ID NO: 173471 - DNA, 305 bp, Homo sapiens
  misc_feature: GYAE6OF01BWL3R.49.65.F10.1.454.CMB.1.raw
  modified_base (261)..(305): a, c, t, g, unknown or other
  misc_feature (261)..(305): n is a, c, g, or t
tcagagtcgagagacacgaccggtgctcgatttagctacgctctaagggtacggacggccaccctgaccaatcagcagggtcgaagccggggatgaggccgactattactcgtcacgtgtgggtacaggtagtagtgatcgatgtggtgttcggcggagggaccaagctgaccgtcctaggtcagcccaaggctgccccctcggtcactctgttcccgcctcctctctctcgactctgagcggctggcaaggcgcgatagnnnnnnnnnnnnnnnnnnnnnnnnnnnnnnnnnnnnnnnnnnnnn

SEQ ID NO: 173472 - DNA, 256 bp, Homo sapiens; identical to SEQ ID NO: 173466
  misc_feature: GYAE6OF01BJEXZ.49.65.F10.1.454.CMB.1.raw
  modified_base (253)..(256): a, c, t, g, unknown or other
  misc_feature (253)..(256): n is a, c, g, or t

SEQ ID NO: 173473 - DNA, 254 bp, Homo sapiens
  misc_feature: GYAE6OF01AMJSJ.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173474 - DNA, 255 bp, Homo sapiens; identical to SEQ ID NO: 173465
  misc_feature: GYAE6OF01BL5SF.49.65.F10.1.454.CMB.1.raw
  modified_base (254)..(255): a, c, t, g, unknown or other
  misc_feature (254)..(255): n is a, c, g, or t

SEQ ID NO: 173475 - DNA, 276 bp, Homo sapiens
  misc_feature: GYAE6OF01CIH1Q.49.65.F10.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (270)..(276): a, c, t, g, unknown or other
  misc_feature (270)..(276): n is a, c, g, or t
tcagagtcgagagacacgaccggtgctcgatttagctacgctctaagggacacggccaccctgaccatcagcagggtcgaagccggggatgaggccgactattactgtcacgtgtggacagtagtagtgatcatgtggtgttcggcggagggaccaagctgaccgtcctaggtcagcccaaggctgccccctggtcactctgttccnccnccctcctctctctacgtacctcgtagcggccggtcgtcggacgaagggccgactagtagnnnnnnn

SEQ ID NO: 173476 - DNA, 264 bp, Homo sapiens
  misc_feature: GYAE6OF01EVAJD.49.65.F10.1.454.CMB.1.raw
  modified_base (255)..(264): a, c, t, g, unknown or other
  misc_feature (255)..(264): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccaccctcctctctctcgactctgagcggctggcaaggcgcatagnnnnnnnnnn

SEQ ID NO: 173477 - DNA, 296 bp, Homo sapiens
  misc_feature: GYAE6OF01ENOPR.49.65.F10.1.454.CMB.1.raw
  modified_base (258)..(264): a, c, t, g, unknown or other
  misc_feature (258)..(264): n is a, c, g, or t
  modified_base (266)..(296): a, c, t, g, unknown or other
  misc_feature (266)..(296): n is a, c, g, or t
tcagagtcgagagacacgaccggtgctcgatttagctacgctctaaggaacccggccaccctgaccatcagccgggtcgaagacggggatgaggccgactattactgtcaggtgtgggatagtggtagtggtgtcgtcttcggagctggggaccagggtcaccgtcctaggtcagccctaaggccaaccccactgtcacgtctgttcccacctcctctctctcgactctgagcgggcctggcaaggtccgcatacgcnnnnnnngnnnnnnnnnnnnnnnnnnnnnnnnnnnnnnn

SEQ ID NO: 173478 - DNA, 253 bp, Homo sapiens
  misc_feature: GYAE6OF01C2IC2.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagn

SEQ ID NO: 173479 - DNA, 256 bp, Homo sapiens
  misc_feature: GYAE6OF01CEVLY.49.65.F10.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgacctgagcgggctggcaaggcgcatagnnnnn

SEQ ID NO: 173480 - DNA, 255 bp, Homo sapiens
  misc_feature: GYAE6OF01BBWN8.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcggctggcaaggcgcatagnn

SEQ ID NO: 173481 - DNA, 275 bp, Homo sapiens
  misc_feature: GYAE6OF01CNP8L.49.65.F10.1.454.CMB.1.raw
  modified_base (259)..(275): a, c, t, g, unknown or other
  misc_feature (259)..(275): n is a, c, g, or t
tcagagtcgagagacacgaccggtgctcgatttagctacgctctaaggggacgacgggccaccctgaccatcagcagggtcgaagccggggatgaggccgactattactgtcacgtcgtgggacagtagtagtgatcatgtggtgttcggcggagggaccaagctgaccgtcctaggtcagcccaaggctgccccctcggtccactctgttcccgccctctctctctcgactctgagcgggctggcaaggcgacatagnnnnnnnnnnnnnnnnn

SEQ ID NO: 173482 - DNA, 255 bp, Homo sapiens
  misc_feature: GYAE6OF01CFVRW.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnn

SEQ ID NO: 173483 - DNA, 270 bp, Homo sapiens
  misc_feature: GYAE6OF01EP2SU.49.65.F10.1.454.CMB.1.raw
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (248)..(270): a, c, t, g, unknown or other
  misc_feature (248)..(270): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgtcgcggnggacgacancacgcctcgtgnacgacgagngcccncccgtgacnctgtcctacccncctctctctcgacnctgtagcggcggtcgcgacgacgcatagtnnnnnnnnnnnnnnnnnnnnnnn

SEQ ID NO: 173484 - DNA, 255 bp, Homo sapiens; identical to SEQ ID NO: 173465
  misc_feature: GYAE6OF01AV965.49.65.F10.1.454.CMB.1.raw
  modified_base (254)..(255): a, c, t, g, unknown or other
  misc_feature (254)..(255): n is a, c, g, or t

SEQ ID NO: 173485 - DNA, 255 bp, Homo sapiens
  misc_feature: GYAE6OF01EWLGF.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnn

SEQ ID NO: 173486 - DNA, 323 bp, Homo sapiens
  misc_feature: GYAE6OF01CDT0L.49.65.F10.1.454.CMB.1.raw
  modified_base (259)..(260): a, c, t, g, unknown or other
  misc_feature (259)..(260): n is a, c, g, or t
  modified_base (263)..(263): a, c, t, g, unknown or other
  misc_feature (263)..(263): n is a, c, g, or t
  modified_base (267)..(323): a, c, t, g, unknown or other
  misc_feature (267)..(323): n is a, c, g, or t
tcagagtcgagagacacgaccggtgctcgatttagctacgctctaagggacgacggccaccctgaccagtcagcagggtcgaagccggggatgaggccgacgtacttactgtcacgtgtgggacagtagtagtgatcatgtgggtgttacggcggaggggaccaaagctgaccgtctaggtcagcccaaggctgccccctggtcactcctgttcccacctctctctctcgactctgagcgggctggcaaggcgcatagnnagnagcnnnnnnnnnnnnnnnnnnnnnnnnnnnnnnnnnnnnnnnnnnnnnnnnnnnnnnnnn

SEQ ID NO: 173487 - DNA, 286 bp, Homo sapiens
  misc_feature: GYAE6OF01CV94N.49.65.F10.1.454.CMB.1.raw
  modified_base (285)..(286): a, c, t, g, unknown or other
  misc_feature (285)..(286): n is a, c, g, or t
tcagagtcgagagacacgaccggtgctcgatttagctacgctctaagggcacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnn

SEQ ID NO: 173488 - DNA, 255 bp, Homo sapiens
  misc_feature: GYAE6OF01DTNEI.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcactctgagcgggctggcaaggcgcatagnn

SEQ ID NO: 173489 - DNA, 255 bp, Homo sapiens; identical to SEQ ID NO: 173485
  misc_feature: GYAE6OF01CQ9HK.49.65.F10.1.454.CMB.1.raw
  modified_base (253)..(255): a, c, t, g, unknown or other
  misc_feature (253)..(255): n is a, c, g, or t

SEQ ID NO: 173490 - DNA, 256 bp, Homo sapiens
  misc_feature: GYAE6OF01A0902.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173491 - DNA, 534 bp, Homo sapiens
  misc_feature: GYAE6OF01C72I8.49.65.F10.1.454.CMB.1.raw
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (317)..(321): a, c, t, g, unknown or other
  misc_feature (317)..(321): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagagtcgagagacacgaccggtgctcgatttagctacgctctaagggaacggacgggaccaccctgaccattcgacgcaggggtaccgaagccgggggatcgaggccgactattactgtctaccgtcgtgggacagtagtaggtgactcatcgtcgggtagtttcggcggtagggaccaagctgacccgtcctaggtccagccctaaggcctgcccccgtaggtcacctcctcgttcccaccctcctcgtcctctcgactctgagcgggctggcaaggtcgccagtacganaactgcagctcagcnctcancatnnnnncncgcgcncncgcncncncgcgcgtngngngngtgngngngngctcnctcncacncncncncncgcgacgcgacgagtagtagttgtcgtagttnttgttgtcgtgtcgngtcgtcgacgacgtcgtacgtacgtacgtcgacgacgacgacgacgacgacgtacgtacgtacgtacgtagtcgtcgacgacgactctcttctctctcgtccg

SEQ ID NO: 173492 - DNA, 256 bp, Homo sapiens
  misc_feature: GYAE6OF01BCNV1.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacgacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173493 - DNA, 464 bp, Homo sapiens
  misc_feature: GYAE6OF01BS08J.49.65.F10.1.454.CMB.1.raw
  modified_base (105)..(105): a, c, t, g, unknown or other
  misc_feature (105)..(105): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (317)..(318): a, c, t, g, unknown or other
  misc_feature (317)..(318): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (456)..(459): a, c, t, g, unknown or other
  misc_feature (456)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
tcagagtcgagagacacgaccggtgctcgatttagctacgctctaaggacgacgccgaccctgaccatcagcaggtcgaagccgggatcgaggccgactattacngtcacgtgtggacagtagtagtgatcatgttggtgttcggcgaggaccaagctgaccgttctaggtcagcccaaggctagccccctggtcacgtcgtgttccccaccgtccgtctctctcgacgtcgtgagcggctggccaaggcgcagtaggncngngtnctcagtatggnngngngcgngcgagntgngngngngngngngngngtgtgnngngagacgcgngngtagtgtagtgagagagcgcgtagagacgacgacgacgacgcacgaganatagagaganagagagagtgnganagagacgntagtgtgagngngngngcgcgngagagngagngngngngcgtgnnnngngng

SEQ ID NO: 173494 - DNA, 288 bp, Homo sapiens
  misc_feature: GYAE6OF01C8KVN.49.65.F10.1.454.CMB.1.raw
  modified_base (260)..(288): a, c, t, g, unknown or other
  misc_feature (260)..(288): n is a, c, g, or t
tcagagtcgagagacacgaccggtgctcgatttagctacgctctaaggggacgacggccaccctgaccatcagcagggtcgaagccggggatcgaggccgactattactgtcacggtgtgggacagtagtagtgatcatgtggtgttcggcggtagggtaccaagctgaccgtcctaggtcagcccaaggctgccccctgggtcactctcgttcccaccctcctctctctcgactctgagcggctggcaaggcgcatagnnnnnnnnnnnnnnnnnnnnnnnnnnnnn

SEQ ID NO: 173495 - DNA, 254 bp, Homo sapiens; identical to SEQ ID NO: 173462
  misc_feature: GYAE6OF01DXR7V.49.65.F10.1.454.CMB.1.raw
  modified_base (253)..(254): a, c, t, g, unknown or other
  misc_feature (253)..(254): n is a, c, g, or t

SEQ ID NO: 173496 - DNA, 254 bp, Homo sapiens; identical to SEQ ID NO: 173473
  misc_feature: GYAE6OF01B6BDB.49.65.F10.1.454.CMB.1.raw
  modified_base (253)..(254): a, c, t, g, unknown or other
  misc_feature (253)..(254): n is a, c, g, or t

SEQ ID NO: 173497 - DNA, 255 bp, Homo sapiens
  misc_feature: GYAE6OF01BCW5U.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccgaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnn

SEQ ID NO: 173498 - DNA, 255 bp, Homo sapiens; identical to SEQ ID NO: 173465
  misc_feature: GYAE6OF01C7VWQ.49.65.F10.1.454.CMB.1.raw
  modified_base (254)..(255): a, c, t, g, unknown or other
  misc_feature (254)..(255): n is a, c, g, or t

SEQ ID NO: 173499 - DNA, 256 bp, Homo sapiens
  misc_feature: GYAE6OF01EZVKS.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccgccctcctctctctcgactctgagcgggctggcaaggcgcatagnn

SEQ ID NO: 173500 - DNA, 256 bp, Homo sapiens; identical to SEQ ID NO: 173490
  misc_feature: GYAE6OF01BMP7I.49.65.F10.1.454.CMB.1.raw
  modified_base (254)..(256): a, c, t, g, unknown or other
  misc_feature (254)..(256): n is a, c, g, or t

SEQ ID NO: 173501 - DNA, 257 bp, Homo sapiens
  misc_feature: GYAE6OF01CEUNQ.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnnnn

SEQ ID NO: 173502 - DNA, 254 bp, Homo sapiens
  misc_feature: GYAE6OF01B3EQ9.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnn

SEQ ID NO: 173503 - DNA, 255 bp, Homo sapiens; identical to SEQ ID NO: 173459
  misc_feature: GYAE6OF01CWPEM.49.65.F10.1.454.CMB.1.raw
  modified_base (253)..(255): a, c, t, g, unknown or other
  misc_feature (253)..(255): n is a, c, g, or t

SEQ ID NO: 173504 - DNA, 254 bp, Homo sapiens; identical to SEQ ID NO: 173463
  misc_feature: GYAE6OF01C5H2J.49.65.F10.1.454.CMB.1.raw
  modified_base (254)..(254): a, c, t, g, unknown or other
  misc_feature (254)..(254): n is a, c, g, or t

SEQ ID NO: 173505 - DNA, 254 bp, Homo sapiens
  misc_feature: GYAE6OF01ES3ZE.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcggctggcaaggcgcatagnn

SEQ ID NO: 173506 - DNA, 254 bp, Homo sapiens
  misc_feature: GYAE6OF01C2D9S.49.65.F10.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnn

SEQ ID NO: 173507 - DNA, 255 bp, Homo sapiens; identical to SEQ ID NO: 173465
  misc_feature: GYAE6OF01AG98E.49.65.F10.1.454.CMB.1.raw
  modified_base (254)..(255): a, c, t, g, unknown or other
  misc_feature (254)..(255): n is a, c, g, or t

SEQ ID NO: 173508 - DNA, 255 bp, Homo sapiens
  misc_feature: GYAE6OF01DR0NU.49.65.F10.1.454.CMB.1.raw
  modified_base (255)..(255): a, c, t, g, unknown or other
  misc_feature (255)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagn

SEQ ID NO: 173509 - DNA, 253 bp, Homo sapiens
  misc_feature: GYAE6OF01D7ROW.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagn

SEQ ID NO: 173510 - DNA, 255 bp, Homo sapiens
  misc_feature: GYAE6OF01BHEPF.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcggctggcaaggcgcatagnnnn

SEQ ID NO: 173511 - DNA, 257 bp, Homo sapiens
  misc_feature: GYAE6OF01BWVSO.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173512 - DNA, 255 bp, Homo sapiens; identical to SEQ ID NO: 173485
  misc_feature: GYAE6OF01C60H7.49.65.F10.1.454.CMB.1.raw
  modified_base (253)..(255): a, c, t, g, unknown or other
  misc_feature (253)..(255): n is a, c, g, or t

SEQ ID NO: 173513 - DNA, 255 bp, Homo sapiens; identical to SEQ ID NO: 173465
  misc_feature: GYAE6OF01EGMEJ.49.65.F10.1.454.CMB.1.raw
  modified_base (254)..(255): a, c, t, g, unknown or other
  misc_feature (254)..(255): n is a, c, g, or t

SEQ ID NO: 173514 - DNA, 255 bp, Homo sapiens; identical to SEQ ID NO: 173465
  misc_feature: GYAE6OF01C7FMC.49.65.F10.1.454.CMB.1.raw
  modified_base (254)..(255): a, c, t, g, unknown or other
  misc_feature (254)..(255): n is a, c, g, or t

SEQ ID NO: 173515 - DNA, 253 bp, Homo sapiens
  misc_feature: GYAE6OF01DFL6H.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcataggtcagcccaaggctgccccctggtcactctgttcccaccctcctctctctcgactctgagcgggctggcaaggcgcatagn

SEQ ID NO: 173516 - DNA, 254 bp, Homo sapiens; identical to SEQ ID NO: 173462
  misc_feature: GYAE6OF01A6GWC.49.65.F10.1.454.CMB.1.raw
  modified_base (253)..(254): a, c, t, g, unknown or other
  misc_feature (253)..(254): n is a, c, g, or t

SEQ ID NO: 173517 - DNA, 255 bp, Homo sapiens; identical to SEQ ID NO: 173485
  misc_feature: GYAE6OF01BG6YG.49.65.F10.1.454.CMB.1.raw
  modified_base (253)..(255): a, c, t, g, unknown or other
  misc_feature (253)..(255): n is a, c, g, or t

SEQ ID NO: 173518 - DNA, 315 bp, Homo sapiens
  misc_feature: GYAE6OF01D70Z7.49.65.F10.1.454.CMB.1.raw
  modified_base (270)..(270): a, c, t, g, unknown or other
  misc_feature (270)..(270): n is a, c, g, or t
  modified_base (274)..(315): a, c, t, g, unknown or other
  misc_feature (274)..(315): n is a, c, g, or t
tcagagtcgagagacacgaccggtgctcgatttagctacgctctaagggacgacggccaccctgaccatcacgcaggggtcgaagccgggggaactgaggccgactatttactgtcacgtgtgggacagtagtagtgatcatggtggtagtttcgggcggtagggaccaagctgaccgtcctaggtccagccctaaggctcgcccccgtcggtcactcctcgttccccaccctcctcgtcctctcgactctgagcgggctggcaaggcgnatgnnnnnnnnnnnnnnnnnnnnnnnnnnnnnnnnnnnnnnnnnn

SEQ ID NO: 173519 - DNA, 256 bp, Homo sapiens; identical to SEQ ID NO: 173490
  misc_feature: GYAE6OF01COHQ6.49.65.F10.1.454.CMB.1.raw
  modified_base (254)..(256): a, c, t, g, unknown or other
  misc_feature (254)..(256): n is a, c, g, or t

SEQ ID NO: 173520 - DNA, 263 bp, Homo sapiens
  misc_feature: GYAE6OF01AXVLE.49.65.F10.1.454.CMB.1.raw
  modified_base (254)..(263): a, c, t, g, unknown or other
  misc_feature (254)..(263): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnnnn

SEQ ID NO: 173521 - DNA, 257 bp, Homo sapiens
  misc_feature: GYAE6OF01CWWQV.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnn

SEQ ID NO: 173522 - DNA, 288 bp, Homo sapiens
  misc_feature: GYAE6OF01E3RLH.49.65.F10.1.454.CMB.1.raw
  modified_base (256)..(288): a, c, t, g, unknown or other
  misc_feature (256)..(288): n is a, c, g, or t
tcagagtcgagagacacgaccggtgctcgatttagctacgctctaagggacacggccaccctgaccatcagcagggtccgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgacgtcgtgagcgggctggcaaggcgcatagnnnnnnnnnnnnnnnnnnnnnnnnnnnnnnnnn

SEQ ID NO: 173523 - DNA, 255 bp, Homo sapiens
  misc_feature: GYAE6OF01AKJ6R.49.65.F10.1.454.CMB.1.raw
  modified_base (245)..(255): a, c, t, g, unknown or other
  misc_feature (245)..(255): n is a, c, g, or t
tcagagtcgagagacacgaccggtgctcgatttagctacgctctaaggacacggccaccctgaccatcagcaggtcgaagccgggatgaggccgactattactgtcacgtgtggacagtagtagtgatcatgtggtgttcggcggagggaccaagctgaccgtcctaggtcagcccaaggctgcccctcggtcactctgttcccgcctctctctctcgactctgagcggctggcaggcgcatagnnnnnnnnnnn

SEQ ID NO: 173524 - DNA, 256 bp, Homo sapiens
  misc_feature: GYAE6OF01AJNXV.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnn

SEQ ID NO: 173525 - DNA, 256 bp, Homo sapiens
  misc_feature: GYAE6OF01A2824.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaagggacacgggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnn

SEQ ID NO: 173526 - DNA, 253 bp, Homo sapiens
  misc_feature: GYAE6OF01DZHZ2.49.65.F10.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnn

SEQ ID NO: 173527 - DNA, 256 bp, Homo sapiens; identical to SEQ ID NO: 173490
  misc_feature: GYAE6OF01A1PL2.49.65.F10.1.454.CMB.1.raw
  modified_base (254)..(256): a, c, t, g, unknown or other
  misc_feature (254)..(256): n is a, c, g, or t

SEQ ID NO: 173528 - DNA, 257 bp, Homo sapiens
  misc_feature: GYAE6OF01D5TF9.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173529 - DNA, 257 bp, Homo sapiens
  misc_feature: GYAE6OF01CDBZ9.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnn

SEQ ID NO: 173530 - DNA, 260 bp, Homo sapiens
  misc_feature: GYAE6OF01CAG6X.49.65.F10.1.454.CMB.1.raw
  modified_base (254)..(260): a, c, t, g, unknown or other
  misc_feature (254)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnn

SEQ ID NO: 173531 - DNA, 287 bp, Homo sapiens
  misc_feature: GYAE6OF01AS368.49.65.F10.1.454.CMB.1.raw
  modified_base (256)..(287): a, c, t, g, unknown or other
  misc_feature (256)..(287): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctggccccctggtcactctgttcccaccctcctctcgtctcgactctgagcgggctggcaaggcgcatagnnnnnnnnnnnnnnnnnnnnnnnnnnnnnnnn

SEQ ID NO: 173532 - DNA, 254 bp, Homo sapiens
  misc_feature: GYAE6OF01DGC23.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnn

SEQ ID NO: 173533 - DNA, 260 bp, Homo sapiens
  misc_feature: GYAE6OF01CDHTA.49.65.F10.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgctctaagggacacggccaccctgaccatcagcagggtcgaagccggggattaggccgactattactgtcacgtgtgggacagtagtagtgatcatgtggtgttcggcggagggaccaagctgaccgtcctaggtcagcccaaggctgcccctggtcactctgttcccaccctcctctctctcgactctgagcgggctggcaaggcgcatagnnnnnnnnn

SEQ ID NO: 173534 - DNA, 257 bp, Homo sapiens
  misc_feature: GYAE6OF01EJV7V.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 173535 - DNA, 290 bp, Homo sapiens
  misc_feature: GYAE6OF01CJIVC.49.65.F10.1.454.CMB.1.raw
  modified_base (287)..(290): a, c, t, g, unknown or other
  misc_feature (287)..(290): n is a, c, g, or t
tcagagtcgagagacacgaccggtgctcgatttagctacgctctaagggcacgaccggtgctcgatttagctacgctctagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173536 - DNA, 267 bp, Homo sapiens
  misc_feature: GYAE6OF01COFF8.49.65.F10.1.454.CMB.1.raw
  modified_base (253)..(267): a, c, t, g, unknown or other
  misc_feature (253)..(267): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnnnnnnnnnnn

SEQ ID NO: 173537 - DNA, 260 bp, Homo sapiens
  misc_feature: GYAE6OF01D2ECT.49.65.F10.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcggctggcaaggcgcatagnnnnnnnnn

SEQ ID NO: 173538 - DNA, 257 bp, Homo sapiens
  misc_feature: GYAE6OF01B4B5A.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccacctcggtcactctgttcccaccctcctctctctcgactctgagcgggctggcaaggcgcatagnnn

SEQ ID NO: 173539 - DNA, 254 bp, Homo sapiens
  misc_feature: GYAE6OF01DCXWX.49.65.F10.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcggctggcaaggcgcatagnnnn

SEQ ID NO: 173540 - DNA, 255 bp, Homo sapiens; identical to SEQ ID NO: 173485
  misc_feature: GYAE6OF01ALUZW.49.65.F10.1.454.CMB.1.raw
  modified_base (253)..(255): a, c, t, g, unknown or other
  misc_feature (253)..(255): n is a, c, g, or t

SEQ ID NO: 173541 - DNA, 255 bp, Homo sapiens; identical to SEQ ID NO: 173465
  misc_feature: GYAE6OF01EOVL6.49.65.F10.1.454.CMB.1.raw
  modified_base (254)..(255): a, c, t, g, unknown or other
  misc_feature (254)..(255): n is a, c, g, or t

SEQ ID NO: 173542 - DNA, 255 bp, Homo sapiens; identical to SEQ ID NO: 173465
  misc_feature: GYAE6OF01BX8BQ.49.65.F10.1.454.CMB.1.raw
  modified_base (254)..(255): a, c, t, g, unknown or other
  misc_feature (254)..(255): n is a, c, g, or t

SEQ ID NO: 173543 - DNA, 253 bp, Homo sapiens; identical to SEQ ID NO: 173478
  misc_feature: GYAE6OF01A9Y9P.49.65.F10.1.454.CMB.1.raw
  modified_base (253)..(253): a, c, t, g, unknown or other
  misc_feature (253)..(253): n is a, c, g, or t

SEQ ID NO: 173544 - DNA, 294 bp, Homo sapiens
  misc_feature: GYAE6OF01EE3YB.49.65.F10.1.454.CMB.1.raw
  modified_base (289)..(294): a, c, t, g, unknown or other
  misc_feature (289)..(294): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnn

SEQ ID NO: 173545 - DNA, 254 bp, Homo sapiens; identical to SEQ ID NO: 173532
  misc_feature: GYAE6OF01DIV4I.49.65.F10.1.454.CMB.1.raw
  modified_base (253)..(254): a, c, t, g, unknown or other
  misc_feature (253)..(254): n is a, c, g, or t

SEQ ID NO: 173546 - DNA, 256 bp, Homo sapiens; identical to SEQ ID NO: 173524
  misc_feature: GYAE6OF01AVR79.49.65.F10.1.454.CMB.1.raw
  modified_base (254)..(256): a, c, t, g, unknown or other
  misc_feature (254)..(256): n is a, c, g, or t

SEQ ID NO: 173547 - DNA, 266 bp, Homo sapiens
  misc_feature: GYAE6OF01BGES9.49.65.F10.1.454.CMB.1.raw
  modified_base (253)..(266): a, c, t, g, unknown or other
  misc_feature (253)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnnnnnnn

SEQ ID NO: 173548 - DNA, 334 bp, Homo sapiens
  misc_feature: GYAE6OF01AZFFJ.49.65.F10.1.454.CMB.1.raw
  modified_base (259)..(259): a, c, t, g, unknown or other
  misc_feature (259)..(259): n is a, c, g, or t
  modified_base (261)..(262): a, c, t, g, unknown or other
  misc_feature (261)..(262): n is a, c, g, or t
  modified_base (265)..(265): a, c, t, g, unknown or other
  misc_feature (265)..(265): n is a, c, g, or t
  modified_base (272)..(334): a, c, t, g, unknown or other
  misc_feature (272)..(334): n is a, c, g, or t
tcagagtcgagagacacgaccggtgctcgatttagctacgctctaagggacacggccaccctgaccatcagcaggggtccgaagccggggatgaggccggactattactgtcacgtgtgggacagtagtagtgatcatgtggtgttcggcggagggaccaagctgaccgtcctaggtcagcccaaggctgccccctggtcactctgttcccaccctctctctctcgactctgagcgggctggacaaagggctacatagnannacngatcacnnnnnnnnnnnnnnnnnnnnnnnnnnnnnnnnnnnnnnnnnnnnnnnnnnnnnnnnnnnnnnn

SEQ ID NO: 173549 - DNA, 292 bp, Homo sapiens
  misc_feature: GYAE6OF01D41ZR.49.65.F10.1.454.CMB.1.raw
  modified_base (288)..(292): a, c, t, g, unknown or other
  misc_feature (288)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagnnnnn

SEQ ID NO: 173550 - DNA, 263 bp, Homo sapiens
  misc_feature: GYAE6OF01BGAXS.49.65.F10.1.454.CMB.1.raw
  modified_base (259)..(263): a, c, t, g, unknown or other
  misc_feature (259)..(263): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctccctctctctcgactctgaggcggcgtggacgaaggcgcatagnnnnn

SEQ ID NO: 173551 - DNA, 306 bp, Homo sapiens
  misc_feature: GYAE6OF01D3BI2.49.65.F10.1.454.CMB.1.raw
  modified_base (248)..(248): a, c, t, g, unknown or other
  misc_feature (248)..(248): n is a, c, g, or t
  modified_base (254)..(306): a, c, t, g, unknown or other
  misc_feature (254)..(306): n is a, c, g, or t
tcagagtcgagagacacgaccggtgctcgatttagctacgctctaagggacgacggtccaccctgaccatcagcagggtcgaagccggggatgaaggaccgactaattactgtcacggtgtgggacagtagtagtgatcatgtggtgttcggcggaggacaagctgaccgtcctaggtcagcccaaggctgccccctggtcactctgtcccgccctctctcctctcgacctgagcggctggcaaggcncatagnnnnnnnnnnnnnnnnnnnnnnnnnnnnnnnnnnnnnnnnnnnnnnnnnnnnn

SEQ ID NO: 173552 - DNA, 260 bp, Homo sapiens
  misc_feature: GYAE6OF01CB7TX.49.65.F10.1.454.CMB.1.raw
  modified_base (255)..(260): a, c, t, g, unknown or other
  misc_feature (255)..(260): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcgggctggcaaggcgcatagnnnnnn

SEQ ID NO: 173553 - DNA, 253 bp, Homo sapiens
  misc_feature: GYAE6OF01EC4NL.49.65.F10.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccacctcctctctctcgactctgagcgggctggcaaggcgcatagnn

SEQ ID NO: 173554 - DNA, 257 bp, Homo sapiens
  misc_feature: GYAE6OF01AL22B.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnn

SEQ ID NO: 173555 - DNA, 306 bp, Homo sapiens
  misc_feature: GYAE6OF01BGEGE.49.65.F10.1.454.CMB.1.raw
  modified_base (283)..(283): a, c, t, g, unknown or other
  misc_feature (283)..(283): n is a, c, g, or t
  modified_base (289)..(306): a, c, t, g, unknown or other
  misc_feature (289)..(306): n is a, c, g, or t
tcagagtcgagagacacgaccggtgctcgatttagctacgctctaagggcacgaccggtgctcgatttagctacgctctaggggacacggccaccctgaccatcagcagggtcgaaggccggggatgaggccgactattactgtcacgtgtgggacagtagtagtgatcatgtggtgttcggcggagggaccaagctgaccgtcctaggtcagcccaagggctgccccctggtcactctgttcccgccctcctctctctcgatctgagcgggctggcaaggcncatagnnnnnnnnnnnnnnnnnn

SEQ ID NO: 173556 - DNA, 255 bp, Homo sapiens; identical to SEQ ID NO: 173456
  misc_feature: GYAE6OF01BMGN3.49.65.F10.1.454.CMB.1.raw
  modified_base (253)..(255): a, c, t, g, unknown or other
  misc_feature (253)..(255): n is a, c, g, or t

SEQ ID NO: 173557 - DNA, 590 bp, Homo sapiens
  misc_feature: GYAE6OF01B8X3M.49.65.F10.1.454.CMB.1.raw
  modified_base (346)..(346): a, c, t, g, unknown or other
  misc_feature (346)..(346): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcggtggtttcgcgtaggctctttaagtaggtgtcagtgtcaggtgcagctggtggagtcgtgggggaggcgtggtccagcctggggaggtccctgagactctcctgtgaagcctctggattcaccttcaagtaacttttggcatgcacgtgggtccgccagggcctccgagggcgacggggctgggaggtgggtggcagttatctnagatgataggaaagtaaaagtctatcggactctgacggcattcacatctcagagacaattaccaagtaacctacttcgacatactaactaaatgcaactacgtctagacgacctggacggtacgacggtctggtatagttacgtggtaggacggggtaagggggtgggttatttttggcgttagttccgggtaacccttcgttacggaaccggttaccggtcgggggtcccgtaaacccggggg

SEQ ID NO: 173558 - DNA, 256 bp, Homo sapiens
  misc_feature: GYAE6OF01A6I2N.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctggcccctcggtcactctgttcccaccctcctctctctcgactctgagcgggctggcaaggcgcatagnnn

SEQ ID NO: 173559 - DNA, 257 bp, Homo sapiens; identical to SEQ ID NO: 173511
  misc_feature: GYAE6OF01D5Z10.49.65.F10.1.454.CMB.1.raw
  modified_base (255)..(257): a, c, t, g, unknown or other
  misc_feature (255)..(257): n is a, c, g, or t

SEQ ID NO: 173560 - DNA, 258 bp, Homo sapiens
  misc_feature: GYAE6OF01CZUN3.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnn

SEQ ID NO: 173561 - DNA, 257 bp, Homo sapiens
  misc_feature: GYAE6OF01E27ML.49.65.F10.1.454.CMB.1.raw
  modified_base (256)..(257): a, c, t, g, unknown or other
  misc_feature (256)..(257): n is a, c, g, or t
tcagagtcgagagacacgaccggtgctcgatttagctacgctctaagggacacggccaccctgaccatcagaaggtcggaagccggggagtgaggccgactattactgtcacgtgtgggacagtagtagtgatcatgtggtgttcggcggagggaccaagctgaccgtcctaggtcagcccaaggctgccccctccggtcactctgttcccaccctcctctctctcgactctgagcgggctggcaaggcgcatagnn

SEQ ID NO: 173562 - DNA, 288 bp, Homo sapiens
  misc_feature: GYAE6OF01EH7N6.49.65.F10.1.454.CMB.1.raw
  modified_base (256)..(288): a, c, t, g, unknown or other
  misc_feature (256)..(288): n is a, c, g, or t
tcagagtcgagagacacgaccggtgctcgatttagctacgctctaaggggacgacggccaccctgaccgatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnnnnnnnnnnnnnnnnnnnnnnnnnn

SEQ ID NO: 173563 - DNA, 255 bp, Homo sapiens; identical to SEQ ID NO: 173465
  misc_feature: GYAE6OF01AOI8C.49.65.F10.1.454.CMB.1.raw
  modified_base (254)..(255): a, c, t, g, unknown or other
  misc_feature (254)..(255): n is a, c, g, or t

SEQ ID NO: 173564 - DNA, 256 bp, Homo sapiens
  misc_feature: GYAE6OF01EEWO9.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnn

SEQ ID NO: 173565 - DNA, 257 bp, Homo sapiens; identical to SEQ ID NO: 173534
  misc_feature: GYAE6OF01EA9WC.49.65.F10.1.454.CMB.1.raw
  modified_base (254)..(257): a, c, t, g, unknown or other
  misc_feature (254)..(257): n is a, c, g, or t

SEQ ID NO: 173566 - DNA, 282 bp, Homo sapiens
  misc_feature: GYAE6OF01AB0VV.49.65.F10.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (252)..(253): a, c, t, g, unknown or other
  misc_feature (252)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (260)..(282): a, c, t, g, unknown or other
  misc_feature (260)..(282): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatggtggtgttcggcggaggaccaagctgaccgtctagtcagcccaaggctgccccctggtcactctgttccccacctcctntctcncgactctgagcggntggcaaggcncaatgannangngcnnnnnnnnnnnnnnnnnnnnnnn

SEQ ID NO: 173567 - DNA, 256 bp, Homo sapiens
  misc_feature: GYAE6OF01EDVLQ.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnn

SEQ ID NO: 173568 - DNA, 256 bp, Homo sapiens
  misc_feature: GYAE6OF01C9J1F.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnn

SEQ ID NO: 173569 - DNA, 256 bp, Homo sapiens; identical to SEQ ID NO: 173490
  misc_feature: GYAE6OF01C54IY.49.65.F10.1.454.CMB.1.raw
  modified_base (254)..(256): a, c, t, g, unknown or other
  misc_feature (254)..(256): n is a, c, g, or t

SEQ ID NO: 173570 - DNA, 285 bp, Homo sapiens
  misc_feature: GYAE6OF01AU09O.49.65.F10.1.454.CMB.1.raw
  modified_base (256)..(285): a, c, t, g, unknown or other
  misc_feature (256)..(285): n is a, c, g, or t
tcagagtcgagagacacgaccggtgctcgatttagctacgctctaaggggacgacggccaccctgaccatcagcagggtcgaagccggggatcgaggccgactattactgtcacgtgtgggacagtagtagtgatcatgtggtgttcggcggagggaccaagctgaccgtctaggtcagcccaaggctgccccctggtcactcgtgttcccaccctcctctctctcgactctgagcgggctggcaaggcgcatagnnnnnnnnnnnnnnnnnnnnnnnnnnnnnn

SEQ ID NO: 173571 - DNA, 281 bp, Homo sapiens
  misc_feature: GYAE6OF01DWC76.49.65.F10.1.454.CMB.1.raw
  modified_base (259)..(281): a, c, t, g, unknown or other
  misc_feature (259)..(281): n is a, c, g, or t
tcagagtcgagagacacgaccggtgctcgatttagctacgctctaagggacacggccaccctgaccactcagcagggtcgaagccgggatgaggccgactattactgtcacgtgtgggacagtagtagtgatcatggtggtgttcggcggagggtaccaagttgaccgtccttaggtcagcccaaggctgccccctcggtcactctgttcccaccctccgtctctctcgactctggagcgggctggcaaggcgcatagnnnnnnnnnnnnnnnnnnnnnnn

SEQ ID NO: 173572 - DNA, 255 bp, Homo sapiens
  misc_feature: GYAE6OF01AWTOR.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcggctggcaaggcgcatagnnn

SEQ ID NO: 173573 - DNA, 289 bp, Homo sapiens
  misc_feature: GYAE6OF01AQFJU.49.65.F10.1.454.CMB.1.raw
  modified_base (289)..(289): a, c, t, g, unknown or other
  misc_feature (289)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagn

SEQ ID NO: 173574 - DNA, 255 bp, Homo sapiens
  misc_feature: GYAE6OF01BEDK5.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnn

SEQ ID NO: 173575 - DNA, 255 bp, Homo sapiens; identical to SEQ ID NO: 173574
  misc_feature: GYAE6OF01DTIQY.49.65.F10.1.454.CMB.1.raw
  modified_base (253)..(255): a, c, t, g, unknown or other
  misc_feature (253)..(255): n is a, c, g, or t

SEQ ID NO: 173576 - DNA, 256 bp, Homo sapiens
  misc_feature: GYAE6OF01A96IY.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnn

SEQ ID NO: 173577 - DNA, 255 bp, Homo sapiens
  misc_feature: GYAE6OF01AXCFV.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnn

SEQ ID NO: 173578 - DNA, 255 bp, Homo sapiens
  misc_feature: GYAE6OF01ANFN1.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnn

SEQ ID NO: 173579 - DNA, 292 bp, Homo sapiens
  misc_feature: GYAE6OF01DR5V0.49.65.F10.1.454.CMB.1.raw
  modified_base (289)..(292): a, c, t, g, unknown or other
  misc_feature (289)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 173580 - DNA, 253 bp, Homo sapiens
  misc_feature: GYAE6OF01CV1JR.49.65.F10.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgctctaagggacacggccaccctgaccatcagcagggtcgaagccggggatgaggccgactattactgtcacgtgtggacagtagtagtgatcatgtggtgttcggcggagggaccaagctgaccgtcctaggtcagcccaaggctgccccctggtcactctgttcccacctcctctctctcgactctgagcgggctggcaaggcgcatagnnn

SEQ ID NO: 173581 - DNA, 254 bp, Homo sapiens
  misc_feature: GYAE6OF01CF7XY.49.65.F10.1.454.CMB.1.raw
  modified_base (254)..(254): a, c, t, g, unknown or other
  misc_feature (254)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagn

SEQ ID NO: 173582 - DNA, 267 bp, Homo sapiens
  misc_feature: GYAE6OF01AJ8PE.49.65.F10.1.454.CMB.1.raw
  modified_base (255)..(267): a, c, t, g, unknown or other
  misc_feature (255)..(267): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcgggctggcaaggcgcatagnnnnnnnnnnnnn

SEQ ID NO: 173583 - DNA, 258 bp, Homo sapiens
  misc_feature: GYAE6OF01AUB3X.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnn

SEQ ID NO: 173584 - DNA, 257 bp, Homo sapiens
  misc_feature: GYAE6OF01BFYK8.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnn

SEQ ID NO: 173585 - DNA, 311 bp, Homo sapiens
  misc_feature: GYAE6OF01B1DCG.49.65.F10.1.454.CMB.1.raw
  modified_base (290)..(311): a, c, t, g, unknown or other
  misc_feature (290)..(311): n is a, c, g, or t
tcagagtcgagagacacgaccggtgctcgatttagctacgctctaagggcacgaccggtgctcgatttagctacgctctaaggggacacggccgaccctgaccatcagcagggtcgaagccggggatgaggccgactattactgtcacgtgtgggacagtagtagtgatcatgtggtgttcggcggagggaccaagctgaccgtcctaggtcagcccaaggctgcccctggtcactctgttcccaccctcctctctctcgactctgagcgggctggccaaggcgcatagnnnnnnnnnnnnnnnnnnnnnn

SEQ ID NO: 173586 - DNA, 274 bp, Homo sapiens
  misc_feature: GYAE6OF01AW7TG.49.65.F10.1.454.CMB.1.raw
  modified_base (254)..(255): a, c, t, g, unknown or other
  misc_feature (254)..(255): n is a, c, g, or t
  modified_base (257)..(274): a, c, t, g, unknown or other
  misc_feature (257)..(274): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnncnnnnnnnnnnnnnnnnnn

SEQ ID NO: 173587 - DNA, 256 bp, Homo sapiens; identical to SEQ ID NO: 173490
  misc_feature: GYAE6OF01BIHVB.49.65.F10.1.454.CMB.1.raw
  modified_base (254)..(256): a, c, t, g, unknown or other
  misc_feature (254)..(256): n is a, c, g, or t

SEQ ID NO: 173588 - DNA, 292 bp, Homo sapiens; identical to SEQ ID NO: 173579
  misc_feature: GYAE6OF01CK5HA.49.65.F10.1.454.CMB.1.raw
  modified_base (289)..(292): a, c, t, g, unknown or other
  misc_feature (289)..(292): n is a, c, g, or t

SEQ ID NO: 173589 - DNA, 275 bp, Homo sapiens
  misc_feature: GYAE6OF01DYJA6.49.65.F10.1.454.CMB.1.raw
  modified_base (254)..(275): a, c, t, g, unknown or other
  misc_feature (254)..(275): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggacaaggcgcatagnnnnnnnnnnnnnnnnnnnnnn

SEQ ID NO: 173590 - DNA, 256 bp, Homo sapiens; identical to SEQ ID NO: 173490
  misc_feature: GYAE6OF01E258H.49.65.F10.1.454.CMB.1.raw
  modified_base (254)..(256): a, c, t, g, unknown or other
  misc_feature (254)..(256): n is a, c, g, or t

SEQ ID NO: 173591 - DNA, 255 bp, Homo sapiens; identical to SEQ ID NO: 173485
  misc_feature: GYAE6OF01EGHHB.49.65.F10.1.454.CMB.1.raw
  modified_base (253)..(255): a, c, t, g, unknown or other
  misc_feature (253)..(255): n is a, c, g, or t

SEQ ID NO: 173592 - DNA, 256 bp, Homo sapiens
  misc_feature: GYAE6OF01DI5KO.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173593 - DNA, 306 bp, Homo sapiens
  misc_feature: GYAE6OF01A6006.49.65.F10.1.454.CMB.1.raw
  modified_base (269)..(306): a, c, t, g, unknown or other
  misc_feature (269)..(306): n is a, c, g, or t
tcagagtcgagagacacgaccggtgctcgatttagctacgctctaagggacacggccaacccggtgaccatcagcagggtcgaagccggggatgaggccgactattactggtcacggtgtgggacagtagtagtgatccatgtggtgttcgggcggagggaccaagcgtcgaccgtcctaggtccagcccaaggctgccccctcggtcactctggttccccgcccctctctctctcgactctgagccgggctggcaagggccgcatagnnnnnnnnnnnnnnnnnnnnnnnnnnnnnnnnnnnnnn

SEQ ID NO: 173594 - DNA, 255 bp, Homo sapiens; identical to SEQ ID NO: 173459
  misc_feature: GYAE6OF01BU5T8.49.65.F10.1.454.CMB.1.raw
  modified_base (253)..(255): a, c, t, g, unknown or other
  misc_feature (253)..(255): n is a, c, g, or t

SEQ ID NO: 173595 - DNA, 257 bp, Homo sapiens; identical to SEQ ID NO: 173534
  misc_feature: GYAE6OF01COVTI.49.65.F10.1.454.CMB.1.raw
  modified_base (254)..(257): a, c, t, g, unknown or other
  misc_feature (254)..(257): n is a, c, g, or t

SEQ ID NO: 173596 - DNA, 255 bp, Homo sapiens
  misc_feature: GYAE6OF01DXEYY.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173597 - DNA, 256 bp, Homo sapiens
  misc_feature: GYAE6OF01AXID3.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173598 - DNA, 606 bp, Homo sapiens
  misc_feature: GYAE6OF01CVGIJ.49.65.F10.1.454.CMB.1.raw
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggagtccctgagactctcctgtgaagcctctggattccaccttcaagaactttggcatgcactggggtccnccagggcctccgaggccgacggggctggggaggtgggtggctagttatctcagntgaataggaaagtaaaagtctaagttcggactccgttaggacgggccgtattcaccatcctacagagacaattaccaaagtaacctacttgacatactaactaaatcgacctacacgtactagaacgtacgtgaacggacacggtcttaggtgttaattaccgtggtaggaccgggtaaggggggtaggggttattttggccgttagttccggaccctacggttacgaccgttacggcggggtaccgtaaccgggg

SEQ ID NO: 173599 - DNA, 280 bp, Homo sapiens
  misc_feature: GYAE6OF01C1GPX.49.65.F10.1.454.CMB.1.raw
  modified_base (203)..(203): a, c, t, g, unknown or other
  misc_feature (203)..(203): n is a, c, g, or t
  modified_base (256)..(280): a, c, t, g, unknown or other
  misc_feature (256)..(280): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatggtggtgttcggcggagggaccaagctgaccgtcctaggtcagcccaaggctgccccctggtcactcngttcccacccgtcctctctctcgactcgtgagcgggctggcaaggcgcatagnnnnnnnnnnnnnnnnnnnnnnnnn

SEQ ID NO: 173600 - DNA, 266 bp, Homo sapiens
  misc_feature: GYAE6OF01EN14D.49.65.F10.1.454.CMB.1.raw
  modified_base (253)..(266): a, c, t, g, unknown or other
  misc_feature (253)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggtaccaagctgaccgtcctaggtcagcccaaggctgccccctggtcactctgttcccgccgtcctctctctcgactcgtgagcggctggcaggcgcatagnnnnnnnnnnnnnn

SEQ ID NO: 173601 - DNA, 255 bp, Homo sapiens
  misc_feature: GYAE6OF01B7YFT.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173602 - DNA, 291 bp, Homo sapiens
  misc_feature: GYAE6OF01BP13M.49.65.F10.1.454.CMB.1.raw
  modified_base (288)..(291): a, c, t, g, unknown or other
  misc_feature (288)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagnnnn

SEQ ID NO: 173603 - DNA, 605 bp, Homo sapiens
  misc_feature: GYAE6OF01C7M1Y.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgaagcctctggattcaccttcaagtaactttggcatgcacgtggtccgccaggctccaggcacggggctggagtgggtggcagttatctcagatgataggaaagtaaaagtactatcggactccttagaacgggccgattcgaccatctccagacgactaactacaaagaactactcgactatactaaacaaatcgaaccacgtagtctagaacgacctggaacgtacgacggtctggtacgttattacgtgtacgggtacggggaagggggtagggttagttttcggcgttaacggttaccggtaacccgtacgttacgaccgtttaacgggccggggtacccggtaaacccggggg

SEQ ID NO: 173604 - DNA, 255 bp, Homo sapiens
  misc_feature: GYAE6OF01B6A7X.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnn

SEQ ID NO: 173605 - DNA, 254 bp, Homo sapiens; identical to SEQ ID NO: 173462
  misc_feature: GYAE6OF01EGM1J.49.65.F10.1.454.CMB.1.raw
  modified_base (253)..(254): a, c, t, g, unknown or other
  misc_feature (253)..(254): n is a, c, g, or t

SEQ ID NO: 173606 - DNA, 277 bp, Homo sapiens
  misc_feature: GYAE6OF01EI5DN.49.65.F10.1.454.CMB.1.raw
  modified_base (259)..(277): a, c, t, g, unknown or other
  misc_feature (259)..(277): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctcggtcactctgttccccacccttcctctctcctcgactctgagcgggctggcaaggcgcatagnnnnnnnnnnnnnnnnnnn

SEQ ID NO: 173607 - DNA, 292 bp, Homo sapiens
  misc_feature: GYAE6OF01EWMRD.49.65.F10.1.454.CMB.1.raw
  modified_base (289)..(292): a, c, t, g, unknown or other
  misc_feature (289)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnn

SEQ ID NO: 173608 - DNA, 269 bp, Homo sapiens
  misc_feature: GYAE6OF01AS14F.49.65.F10.1.454.CMB.1.raw
  modified_base (256)..(269): a, c, t, g, unknown or other
  misc_feature (256)..(269): n is a, c, g, or t
tcagagtcgagagacacgaccggtgctcgatttagctacgctctaaggggacacgggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnnnnnnnn

SEQ ID NO: 173609 - DNA, 257 bp, Homo sapiens
  misc_feature: GYAE6OF01AG67W.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnn

SEQ ID NO: 173610 - DNA, 254 bp, Homo sapiens; identical to SEQ ID NO: 173462
  misc_feature: GYAE6OF01BLXM8.49.65.F10.1.454.CMB.1.raw
  modified_base (253)..(254): a, c, t, g, unknown or other
  misc_feature (253)..(254): n is a, c, g, or t

SEQ ID NO: 173611 - DNA, 289 bp, Homo sapiens
  misc_feature: GYAE6OF01BZLN5.49.65.F10.1.454.CMB.1.raw
  modified_base (287)..(289): a, c, t, g, unknown or other
  misc_feature (287)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctggtcactctgttcccaccctcctctctctcgactctgagcgggctggcaaggcgcatagnnn

SEQ ID NO: 173612 - DNA, 592 bp, Homo sapiens
  misc_feature: GYAE6OF01B7X6D.49.65.F10.1.454.CMB.1.raw
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (296)..(297): a, c, t, g, unknown or other
  misc_feature (296)..(297): n is a, c, g, or t
  modified_base (342)..(342): a, c, t, g, unknown or other
  misc_feature (342)..(342): n is a, c, g, or t
tcagagtcgagagacacgaccggtgctcgatttagctacgctctaaggggacacgggccaccctggaccatcaggcagggtcgaagccggggatgaggccgactacttactgttcacgttcgtgggacagtagtagtgatcatgtggtgttcggcggagggaccaagctgaccgtctaggtcagtcccaaggctgccccctggtcactctgttcccaccgtcctctctctcgactctgagcgggctggcaaggtcgactaatagncanatagatatgatcgacagcacgaccncgnngctatagatgtcgtacgtcgcgcgacgcgtagccgtacatacgtntcgcgcgcggcgtacgacgacgacgtactactactactacacacgacgtacgacgacgcgacgacggacgtagagtacgtacgtacgttacgttacgtacgtacgtcgtacgtacgtaacgtactacgtacgtacgttacgttacgttacgttacgtacggtaacggtacggtacggtaacgtaacgtaacgtacgtacgtacggtacggtacgtacgtaccgtacgtacgtacgttcgtccgtcgtacg

SEQ ID NO: 173613 - DNA, 608 bp, Homo sapiens
  misc_feature: GYAE6OF01BN8SF.49.65.F10.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtcgtggggaggcgtggtccagcctgggaggtccctgagactctcctgtgaagcctntggattcaccttcaagtaactttggcatgcacgtcgggtccgccaggcctccgacggcgacggggctgggaggtgggtggctaggttatctcagatgataggaaagtaaaaagtactagttcggactccgttagaaggccgtattcgaccatctccagagactaacttacaaagtaacaccttgactatactaacaaatcgacacagtcctagacgtaccagacgacgtaccggagttcgtagttaacgttacgtggtcggaacgggtaaggggggtagggttagttttagggaccgttaggttaccggacccttacggttacgtaacggtcccggttgggggcccgtaaaccgggg

SEQ ID NO: 173614 - DNA, 258 bp, Homo sapiens
  misc_feature: GYAE6OF01EEFL2.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnn

SEQ ID NO: 173615 - DNA, 256 bp, Homo sapiens; identical to SEQ ID NO: 173490
  misc_feature: GYAE6OF01EANVJ.49.65.F10.1.454.CMB.1.raw
  modified_base (254)..(256): a, c, t, g, unknown or other
  misc_feature (254)..(256): n is a, c, g, or t

SEQ ID NO: 173616 - DNA, 256 bp, Homo sapiens
  misc_feature: GYAE6OF01ED6PD.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnn

SEQ ID NO: 173617 - DNA, 257 bp, Homo sapiens
  misc_feature: GYAE6OF01CLS2N.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccacctcctctctctcgactctgagcgggctggcaaggcgcatagnnnn

SEQ ID NO: 173618 - DNA, 257 bp, Homo sapiens; identical to SEQ ID NO: 173534
  misc_feature: GYAE6OF01DOGQU.49.65.F10.1.454.CMB.1.raw
  modified_base (254)..(257): a, c, t, g, unknown or other
  misc_feature (254)..(257): n is a, c, g, or t

SEQ ID NO: 173619 - DNA, 259 bp, Homo sapiens
  misc_feature: GYAE6OF01DBEXJ.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnn

SEQ ID NO: 173620 - DNA, 598 bp, Homo sapiens
  misc_feature: GYAE6OF01BJV0R.49.65.F10.1.454.CMB.1.raw
  modified_base (294)..(294): a, c, t, g, unknown or other
  misc_feature (294)..(294): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcgtggtttcctcgttagctctttaagaggtgtccagtgtcaggtgcagctggtggagtctgggggaggcgtgggtccagcctggggaggtccctgagactctcctgtgaagcctctggattcaccttcaagtaactttggcatgcactggtccncaggctccgaggcacggggctggagtgggtggcaggttatctcagtatgatggaaataaaagtctagtcggactccgttaggaacgggccgattcgacctatcctacagagacaattacaagaaccacttgcatctaacaatgacacagtctagacgacctagacggtacacggtctaggtagtacttaccgtggtacggacggggtaaggggggttacggggttatttttagggccgttagtttacggaacccgttacgttacggtaaccgttaccggtcgggggtaccccgtaaaccggggg

SEQ ID NO: 173621 - DNA, 256 bp, Homo sapiens; identical to SEQ ID NO: 173597
  misc_feature: GYAE6OF01AIRGC.49.65.F10.1.454.CMB.1.raw
  modified_base (255)..(256): a, c, t, g, unknown or other
  misc_feature (255)..(256): n is a, c, g, or t

SEQ ID NO: 173622 - DNA, 257 bp, Homo sapiens; identical to SEQ ID NO: 173609
  misc_feature: GYAE6OF01CN0G6.49.65.F10.1.454.CMB.1.raw
  modified_base (254)..(257): a, c, t, g, unknown or other
  misc_feature (254)..(257): n is a, c, g, or t

SEQ ID NO: 173623 - DNA, 348 bp, Homo sapiens
  misc_feature: GYAE6OF01BPVW6.49.65.F10.1.454.CMB.1.raw
  modified_base (271)..(272): a, c, t, g, unknown or other
  misc_feature (271)..(272): n is a, c, g, or t
  modified_base (275)..(275): a, c, t, g, unknown or other
  misc_feature (275)..(275): n is a, c, g, or t
  modified_base (278)..(348): a, c, t, g, unknown or other
  misc_feature (278)..(348): n is a, c, g, or t
tcagagtcgagagacacgaccggtgctcgatttagctacgctctaagggacgaacgggccgaccctggaccatcaagcaggggtcgaagccgggggatgagggccgactattacctgtcacgtcgtgggacagtagtagtgatcatgtggtgttcggcggagggaccaagctgaccgtcctaggtcacgccccaagggctgccccctggtccacgtctggttccccaccctcctctctctcgactctgagcgggctggcaaggcacatagnngtncannnnnnnnnnnnnnnnnnnnnnnnnnnnnnnnnnnnnnnnnnnnnnnnnnnnnnnnnnnnnnnnnnnnnnn

SEQ ID NO: 173624 - DNA, 255 bp, Homo sapiens
  misc_feature: GYAE6OF01EWFET.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnn

SEQ ID NO: 173625 - DNA, 666 bp, Homo sapiens
  misc_feature: GYAE6OF01AVQC9.49.65.F10.1.454.CMB.1.raw
  modified_base (250)..(250): a, c, t, g, unknown or other
  misc_feature (250)..(250): n is a, c, g, or t
tcagagtcgagagacacgaccggtgctcgatttagctacgctctaagggacacggccaccctgaccatcagcagggtcgaagacggggatgaggccgatattactgtcaggtgtgggatagtggtagtggtgtcgtcttcggagctgggaccagggtcaccgtctaggtcagcccaaggccaacccatgtcactctgttcccagtctcctctctctgactctgagcgggtctggcaaaggcgcaattggnaccggttacgtcgtacgtacgtacgtacgtacgtacgtacgtacgtacgtcgtacgtacgtacgtacgtacgtacgtacgtacgtacgtacgtacgtacgtacgtacgtacgtacgtacgtacgtacgtacgtacgtaccgtacgtacgtcgtacgtcgtacgtacgtacgtacgtacgtacgtacgtacgtacgtacgtacgtacgtacgtccgtagtacgtacgtcgtacgtacgtacgtacgtacgtacgtcgtacgtacgtaccgtagtacgtacgtacgtaccgtacgtcgtacgttcgtaccgtacgtcgtacgtacgtacgtaccgtacgtacgtaccgtacgtccgttagtacgtacgttagtaccggtacttcggtaaccgtacggtaccgttcgtacgtccgtacg

SEQ ID NO: 173626 - DNA, 253 bp, Homo sapiens
  misc_feature: GYAE6OF01AXD3E.49.65.F10.1.454.CMB.1.raw
  modified_base (248)..(253): a, c, t, g, unknown or other
  misc_feature (248)..(253): n is a, c, g, or t
tcagagtcgagagacacgaccggtgctcgatttagctacgctctaagggacacggccaccctgaccatcagcaggtcgaagccgggatgaggccgactattactgtcacgtgtggacagtagtagtgatcatgtggtgttcggcggagggaccaagctgaccgtcctaggtcagcccaaggctgccccctggtcactctgttcccacctcctctctctcgactctgagcggctggcaaggcgcatagnnnnnn

SEQ ID NO: 173627 - DNA, 293 bp, Homo sapiens
  misc_feature: GYAE6OF01BRBGS.49.65.F10.1.454.CMB.1.raw
  modified_base (286)..(293): a, c, t, g, unknown or other
  misc_feature (286)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctggtcactctgttcccgcctcctctctctcgactctgagcgggctggcaaggcgcatagnnnnnnnn

SEQ ID NO: 173628 - DNA, 286 bp, Homo sapiens
  misc_feature: GYAE6OF01B02DN.49.65.F10.1.454.CMB.1.raw
  modified_base (257)..(286): a, c, t, g, unknown or other
  misc_feature (257)..(286): n is a, c, g, or t
tcagagtcgagagacacgaccggtgctcgatttagctacgctctaagggacacggccaccctgaccatcagcagggtcgaagccggggatgaggccgactattactgtcacgtggtgggacagtagtagtgatcatggtggtgttcggcggagggaccaagctgaccgtcctaggtccagcccaaggctcgccccctggtcactctgttcccgccctcctctctctcgactctgagcgggctggcaaggcgcatagnnnnnnnnnnnnnnnnnnnnnnnnnnnnnn

SEQ ID NO: 173629 - DNA, 258 bp, Homo sapiens
  misc_feature: GYAE6OF01AGAJI.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaggcgcatagnnnnn

SEQ ID NO: 173630 - DNA, 591 bp, Homo sapiens
  misc_feature: GYAE6OF01C3Y0L.49.65.F10.1.454.CMB.1.raw
  modified_base (326)..(326): a, c, t, g, unknown or other
  misc_feature (326)..(326): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgaagcctctggattcaccttcaagtaactttggcatgcactgggtccgcaggcctccaggcacggggctggaggtgggnggcagttatctcagatggatagggaaagtaaaaagtactattcggtactccttaggaagggccgattcaccatctcagagactaattaccaagaacaccttacgacactactaacaaatcgacactagtctagacgacctggaacgacgacgcgtgtgttattacgtggtcggtacgggaaggggggtaggggtaagtttttcggcgtagttacgggtaccctacgtttacggaaccgttacggtcggggaccgtaaacccgggg

SEQ ID NO: 173631 - DNA, 255 bp, Homo sapiens; identical to SEQ ID NO: 173604
  misc_feature: GYAE6OF01EDW2K.49.65.F10.1.454.CMB.1.raw
  modified_base (254)..(255): a, c, t, g, unknown or other
  misc_feature (254)..(255): n is a, c, g, or t

SEQ ID NO: 173632 - DNA, 257 bp, Homo sapiens
  misc_feature: GYAE6OF01BQ2L9.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggatgccccctggtcactctgttccccgccctcctctctctcgactctgagcgggctggcaaggcgcatagnnnn

SEQ ID NO: 173633 - DNA, 540 bp, Homo sapiens
  misc_feature: GYAE6OF01A3555.49.65.F10.1.454.CMB.1.raw
  modified_base (291)..(291): a, c, t, g, unknown or other
  misc_feature (291)..(291): n is a, c, g, or t
tcagagtcgagagacacgaccggtgctcgatttagctacgctctaaggggggagaggagcccagcactagaagtcggcggtgttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccnccaggctccaggcacggggctggagtgggtgcagttatctcagatgatggaaataaaagtctattcggactcctgaagggccattcaccatctccagagacaattccaagaacaccttagcatctaacaaatgacacagtctgagacctgagaccaggctgtgtattactgtggacggtaagggggacgggtagttttcggcgtagttcggacccgtacttaggaactacgtcggggccgtaaccgggg

SEQ ID NO: 173634 - DNA, 276 bp, Homo sapiens
  misc_feature: GYAE6OF01ELW4J.49.65.F10.1.454.CMB.1.raw
  modified_base (247)..(247): a, c, t, g, unknown or other
  misc_feature (247)..(247): n is a, c, g, or t
  modified_base (253)..(276): a, c, t, g, unknown or other
  misc_feature (253)..(276): n is a, c, g, or t
tcagagtcgagagacacgaccggtgctcgatttagctacgctctaagggacacggccaaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccaccctctctctctcgactctgagcgggctggcaaggcncatagnnnnnnnnnnnnnnnnnnnnnnnn

SEQ ID NO: 173635 - DNA, 271 bp, Homo sapiens
  misc_feature: GYAE6OF01C7EL5.49.65.F10.1.454.CMB.1.raw
  modified_base (249)..(249): a, c, t, g, unknown or other
  misc_feature (249)..(249): n is a, c, g, or t
  modified_base (255)..(271): a, c, t, g, unknown or other
  misc_feature (255)..(271): n is a, c, g, or t
tcagagtcgagagacacgaccggtgctcgatttagctacgctctaaggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtcactctcgttccccaccctcctctctcgtcgactcctgagcgggctggcaaggcncatagnnnnnnnnnnnnnnnnn

SEQ ID NO: 173636 - DNA, 301 bp, Homo sapiens
  misc_feature: GYAE6OF01ANYY7.49.65.F10.1.454.CMB.1.raw
  modified_base (288)..(301): a, c, t, g, unknown or other
  misc_feature (288)..(301): n is a, c, g, or t
tcagagtcgagagacacgaccggtgctcgatttagctacgctctaagggcacggaccggtgctcgatttagctacgctctagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnnnnnnnnnn

SEQ ID NO: 173637 - DNA, 264 bp, Homo sapiens
  misc_feature: GYAE6OF01C39T0.49.65.F10.1.454.CMB.1.raw
  modified_base (262)..(264): a, c, t, g, unknown or other
  misc_feature (262)..(264): n is a, c, g, or t
tcagagtcgagagacacgaccggtgctcgatttagctacgctctaagggacacggccaccctgaccatcagcagggtcgaagccgggatgaggcgactattactgtcacgtgtggacgagtagtagtgatcatgtggtgttcggtcgggagggaccgaagctgaccgtcctaggtcgagcccaacggctgcccccctccggttcactctcgttcccacccctccctctctctcgactctgagcgggctggcaagcgcatagnnn

SEQ ID NO: 173638 - DNA, 260 bp, Homo sapiens
  misc_feature: GYAE6OF01C0F8T.49.65.F10.1.454.CMB.1.raw
  modified_base (255)..(260): a, c, t, g, unknown or other
  misc_feature (255)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccaccctcctctctctcgactctgagcgggctggcaaggcgcatagnnnnnn

SEQ ID NO: 173639 - DNA, 257 bp, Homo sapiens
  misc_feature: GYAE6OF01EMICA.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaatgctgccccctggtcactctgttcccgccctcctctctctcgactctgagcgggctggcaaggcgcatagnnnnn

SEQ ID NO: 173640 - DNA, 293 bp, Homo sapiens
  misc_feature: GYAE6OF01BSMIY.49.65.F10.1.454.CMB.1.raw
  modified_base (258)..(293): a, c, t, g, unknown or other
  misc_feature (258)..(293): n is a, c, g, or t
tcagagtcgagagacacgaccggtgctcgatttagctacgctctaagggacgacggccaccctgaccatcagcagggtcgaagccggggatcgaggccgactattactgtcacgtgtgggacagtagtagtgatcatgtggtgttcggcggagggaccaagctgaccgtcctaggtcagcccaaggctgcccccctggtcactctcgttccccgccctcctctctctcgactctgagcgggctggcaaggcgcatagnnnnnnnnnnnnnnnnnnnnnnnnnnnnnnnnnnnn

SEQ ID NO: 173641 - DNA, 772 bp, Homo sapiens
  misc_feature: GYAE6OF01AYP28.49.65.F10.1.454.CMB.1.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcgtgggttttcctcgttagctcttttaagaggtgtccagtgtcaggtgcagctgggtggagtcgtgggggagcgtggtccagccgtggggagtccctgagactctcctgtgaacgcctntgattcaccttcaagtaactttggctatgctacgtcgggtccnccaggcctccgaggccgacggggctgggaggtggggtgctaggttactcgtacgagtagtgaagtagggaaaaagttaaaagtacttaagtttccggacttaccgttagggaaacgggtccgtaatttcccgaaacctacgttaccgtaccgaacggtaacgtaaccctaaacgttacccgaaaacgtaaacccttaacccgtttacgaacctaacttacccgttaaaaccaaaacgttccgaacctaacgtaacgttaccgtaaggaaccgtaacccgttaggaaccgggtaaccgtaccggtacgttacggttagttaacgtttacggtagggttacgggacgggggttaaaagggggggtacggggtttaatttttacgggaacgtttaccgggttaaccggtaaccccgttacggtttacgggaacccggtttacgggttaccggggaccccggttaaacccgggg

SEQ ID NO: 173642 - DNA, 254 bp, Homo sapiens
  misc_feature: GYAE6OF01ASOXQ.49.65.F10.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccaccctctctctctcgactctgagcgggctggcaaggcgcatagnnn

SEQ ID NO: 173643 - DNA, 274 bp, Homo sapiens
  misc_feature: GYAE6OF01BY4JW.49.65.F10.1.454.CMB.1.raw
  modified_base (257)..(274): a, c, t, g, unknown or other
  misc_feature (257)..(274): n is a, c, g, or t
tcagagtcgagagacacgaccggtgctcgatttagctacgctctaagggacgacggccgaccctgaccatcagcagggtcgaaggccggggatgaggccgactattacgtgtcacgtgtgggacagtagtagtgatcatgtggtgttcggcggagggaccaagctgaccgtcctaggtcagcccaaggctgcccctggtcactctgttcccaccctcctctactctcgactctgagcgggctggcaaggcgcatagnnnnnnnnnnnnnnnnnn

SEQ ID NO: 173644 - DNA, 257 bp, Homo sapiens; identical to SEQ ID NO: 173534
  misc_feature: GYAE6OF01B5P5Y.49.65.F10.1.454.CMB.1.raw
  modified_base (254)..(257): a, c, t, g, unknown or other
  misc_feature (254)..(257): n is a, c, g, or t

SEQ ID NO: 173645 - DNA, 259 bp, Homo sapiens
  misc_feature: GYAE6OF01B6GPN.49.65.F10.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnn

SEQ ID NO: 173646 - DNA, 255 bp, Homo sapiens; identical to SEQ ID NO: 173485
  misc_feature: GYAE6OF01BIXRD.49.65.F10.1.454.CMB.1.raw
  modified_base (253)..(255): a, c, t, g, unknown or other
  misc_feature (253)..(255): n is a, c, g, or t

SEQ ID NO: 173647 - DNA, 259 bp, Homo sapiens
  misc_feature: GYAE6OF01D8Z6C.49.65.F10.1.454.CMB.1.raw
  modified_base (256)..(259): a, c, t, g, unknown or other
  misc_feature (256)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttccccgccctcctctctctcgactctgagcggctggcaaggcgcatagnnnn

SEQ ID NO: 173648 - DNA, 257 bp, Homo sapiens
  misc_feature: GYAE6OF01ETKES.49.65.F10.1.454.CMB.1.raw
  modified_base (256)..(257): a, c, t, g, unknown or other
  misc_feature (256)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnn

SEQ ID NO: 173649 - DNA, 350 bp, Homo sapiens
  misc_feature: GYAE6OF01APILJ.49.65.F10.1.454.CMB.1.raw
  modified_base (294)..(296): a, c, t, g, unknown or other
  misc_feature (294)..(296): n is a, c, g, or t
  modified_base (298)..(300): a, c, t, g, unknown or other
  misc_feature (298)..(300): n is a, c, g, or t
  modified_base (302)..(302): a, c, t, g, unknown or other
  misc_feature (302)..(302): n is a, c, g, or t
  modified_base (304)..(350): a, c, t, g, unknown or other
  misc_feature (304)..(350): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctgttccccgccctcctctctctcgactctgacgccgggctggcaaggcgcatagcnnngnnnancnnnnnnnnnnnnnnnnnnnnnnnnnnnnnnnnnnnnnnnnnnnnnnn

SEQ ID NO: 173650 - DNA, 257 bp, Homo sapiens
  misc_feature: GYAE6OF01CS1O3.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcttcccctcggtcactctgttcccaccctcctctctctcgactctgagcgggctggcaaggcgcatagnnnnn

SEQ ID NO: 173651 - DNA, 256 bp, Homo sapiens; identical to SEQ ID NO: 173564
  misc_feature: GYAE6OF01BKBYD.49.65.F10.1.454.CMB.1.raw
  modified_base (253)..(256): a, c, t, g, unknown or other
  misc_feature (253)..(256): n is a, c, g, or t

SEQ ID NO: 173652 - DNA, 255 bp, Homo sapiens
  misc_feature: GYAE6OF01CEL4D.49.65.F10.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctactctgagcgggctggcaaggcgcatagnnnnn

SEQ ID NO: 173653 - DNA, 263 bp, Homo sapiens
  misc_feature: GYAE6OF01DOP62.49.65.F10.1.454.CMB.1.raw
  modified_base (254)..(263): a, c, t, g, unknown or other
  misc_feature (254)..(263): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgactctgagcgggctggcaaggcgcatagnnnnnnnnnn

SEQ ID NO: 173654 - DNA, 257 bp, Homo sapiens
  misc_feature: GYAE6OF01D16GC.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggcaaggcgcatagnnn

SEQ ID NO: 173655 - DNA, 254 bp, Homo sapiens
  misc_feature: GYAE6OF01BSHUN.49.65.F10.1.454.CMB.1.raw
  modified_base (254)..(254): a, c, t, g, unknown or other
  misc_feature (254)..(254): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagn

SEQ ID NO: 173656 - DNA, 256 bp, Homo sapiens
  misc_feature: GYAE6OF01BB56B.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 173657 - DNA, 258 bp, Homo sapiens
  misc_feature: GYAE6OF01DLAF6.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcggctggcaaggcgcatagnnnnnn

SEQ ID NO: 173658 - DNA, 257 bp, Homo sapiens
  misc_feature: GYAE6OF01CF2V0.49.65.F10.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtcactctgttcccgccctcctctctctcgactctgagcgggctggcaaggcgcatagnnnnnn

SEQ ID NO: 173659 - DNA, 257 bp, Homo sapiens; identical to SEQ ID NO: 173609
  misc_feature: GYAE6OF01BB7HS.49.65.F10.1.454.CMB.1.raw
  modified_base (254)..(257): a, c, t, g, unknown or other
  misc_feature (254)..(257): n is a, c, g, or t

SEQ ID NO: 173660 - DNA, 316 bp, Homo sapiens
  misc_feature: GYAE6OF01EN61X.49.65.F10.1.454.CMB.1.raw
  modified_base (88)..(88): a, c, t, g, unknown or other
  misc_feature (88)..(88): n is a, c, g, or t
  modified_base (264)..(264): a, c, t, g, unknown or other
  misc_feature (264)..(264): n is a, c, g, or t
  modified_base (271)..(316): a, c, t, g, unknown or other
  misc_feature (271)..(316): n is a, c, g, or t
tcagagtcgagagacacgaccggtgctcgattttagctacgctctaagggacgacggccaccctgaccattcacgcaggggtccgaanccgggggaactgaggccgactatttactgtcacgtgtgggacagtagtagtgatcatgtggtagtttcggcggagggaccaagctgaccgtcctaggtcagccctaaggctgcccccgtcggtcactctcgttccccaccctcctcgtcctctcgactctgagcggctggcaggcncgatagnnnnnnnnnnnnnnnnnnnnnnnnnnnnnnnnnnnnnnnnnnnnnn

SEQ ID NO: 173661 - DNA, 256 bp, Homo sapiens
  misc_feature: GYAE6OF01DXWE4.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnn

SEQ ID NO: 173662 - DNA, 280 bp, Homo sapiens
  misc_feature: GYAE6OF01BUKJG.49.65.F10.1.454.CMB.1.raw
  modified_base (258)..(280): a, c, t, g, unknown or other
  misc_feature (258)..(280): n is a, c, g, or t
tcagagtcgagagacacgaccggtgctcgatttagctacgctctaaggggacacggccaccctgaccatcagcagggtcgaagccggggactgaggccgactattactgtcacgtgtgggacagtagtagtgatcatgtggtgttacggcggagggaccaagctgaccgtcctaggtcagcccaaggctgccccctcggtcactctcgttccccaccctcctctctctcgactctgagcggctggcaaggcgcatagnnnnnnnnnnnnnnnnnnnnnnn

SEQ ID NO: 173663 - DNA, 253 bp, Homo sapiens
  misc_feature: GYAE6OF01APM8N.49.65.F10.1.454.CMB.1.raw
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatag

SEQ ID NO: 173664 - DNA, 255 bp, Homo sapiens; identical to SEQ ID NO: 173508
  misc_feature: GYAE6OF01BH9KG.49.65.F10.1.454.CMB.1.raw
  modified_base (255)..(255): a, c, t, g, unknown or other
  misc_feature (255)..(255): n is a, c, g, or t

SEQ ID NO: 173665 - DNA, 253 bp, Homo sapiens; identical to SEQ ID NO: 173478
  misc_feature: GYAE6OF01CX5HB.49.65.F10.1.454.CMB.1.raw
  modified_base (253)..(253): a, c, t, g, unknown or other
  misc_feature (253)..(253): n is a, c, g, or t

SEQ ID NO: 173666 - DNA, 255 bp, Homo sapiens; identical to SEQ ID NO: 173574
  misc_feature: GYAE6OF01CAM76.49.65.F10.1.454.CMB.1.raw
  modified_base (253)..(255): a, c, t, g, unknown or other
  misc_feature (253)..(255): n is a, c, g, or t

SEQ ID NO: 173667 - DNA, 329 bp, Homo sapiens
  misc_feature: GYAE6OF01C53LN.49.65.F10.1.454.CMB.1.raw
  modified_base (297)..(329): a, c, t, g, unknown or other
  misc_feature (297)..(329): n is a, c, g, or t
tcagagtcgagagacacgaccggtgctcgatttagctacgctctaagggcgaccgaccggtgctcgatttagctacgctctaggggacacggccaccctgaccatcagcagggtcgaagccggggatgaggccgactattactggtcacggtgtgggacagtagtagtgatcaatgtaggtgttcggcggagggaccaagctgaccgtcctaggtcagcccaaggctgccccctcggtcactctcgttcccaccctctctctctcgactctgagcgggctggccaaaggcgcatagnnnnnnnnnnnnnnnnnnnnnnnnnnnnnnnnn

SEQ ID NO: 173668 - DNA, 280 bp, Homo sapiens
  misc_feature: GYAE6OF01ARG61.49.65.F10.1.454.CMB.1.raw
  modified_base (256)..(280): a, c, t, g, unknown or other
  misc_feature (256)..(280): n is a, c, g, or t
tcagagtcgagagacacgaccggtgctcgatttagctacgctctaaggggtacgacggccaccctgaccatcagcaggtcgaagaccgggatgaggccgactattactgtcacgtgtgggacagtagtagtgatcatgtggtgttcggcggagggaccaagctgaccgtcctaggtcagcccaaggctgccccctggtcactctggttccccacctcctctctctcgactctgagcgggctggcaaggcgcatagnnnnnnnnnnnnnnnnnnnnnnnnn

SEQ ID NO: 173669 - DNA, 161 bp, Homo sapiens
  misc_feature: GYAE6OF01DH7BW.49.65.F10.1.454.CMB.1.raw
  modified_base (160)..(161): a, c, t, g, unknown or other
  misc_feature (160)..(161): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcggctggcaaggcgcatagnn

SEQ ID NO: 173670 - DNA, 256 bp, Homo sapiens
  misc_feature: GYAE6OF01E25PV.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnn

SEQ ID NO: 173671 - DNA, 260 bp, Homo sapiens
  misc_feature: GYAE6OF01B5MBL.49.65.F10.1.454.CMB.1.raw
  modified_base (257)..(260): a, c, t, g, unknown or other
  misc_feature (257)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccgccctcctctctctcgactctgagcgggctggcaaggcgcaggtagnnnn

SEQ ID NO: 173672 - DNA, 257 bp, Homo sapiens
  misc_feature: GYAE6OF01CNO78.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcgggctggcaaggcgcatagnnn

SEQ ID NO: 173673 - DNA, 256 bp, Homo sapiens
  misc_feature: GYAE6OF01DJNG9.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctcctctcgacgtagcgggctggcaaggcgcatagnnnn

SEQ ID NO: 173674 - DNA, 256 bp, Homo sapiens
  misc_feature: GYAE6OF01D9TUY.49.65.F10.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggtcactctgttccccaccctcctctctctcgactctgagcgggctggcaaggcgcatagnn

SEQ ID NO: 173675 - DNA, 257 bp, Homo sapiens; identical to SEQ ID NO: 173554
  misc_feature: GYAE6OF01BHXN2.49.65.F10.1.454.CMB.1.raw
  modified_base (253)..(257): a, c, t, g, unknown or other
  misc_feature (253)..(257): n is a, c, g, or t

SEQ ID NO: 173676 - DNA, 289 bp, Homo sapiens
  misc_feature: GYAE6OF01B5EXC.49.65.F10.1.454.CMB.1.raw
  modified_base (289)..(289): a, c, t, g, unknown or other
  misc_feature (289)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagn

SEQ ID NO: 173677 - DNA, 257 bp, Homo sapiens; identical to SEQ ID NO: 173609
  misc_feature: GYAE6OF01CI5HM.49.65.F10.1.454.CMB.1.raw
  modified_base (254)..(257): a, c, t, g, unknown or other
  misc_feature (254)..(257): n is a, c, g, or t

SEQ ID NO: 173678 - DNA, 258 bp, Homo sapiens; identical to SEQ ID NO: 173614
  misc_feature: GYAE6OF01C5OMC.49.65.F10.1.454.CMB.1.raw
  modified_base (254)..(258): a, c, t, g, unknown or other
  misc_feature (254)..(258): n is a, c, g, or t

SEQ ID NO: 173679 - DNA, 255 bp, Homo sapiens
  misc_feature: GYAE6OF01DOI24.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgcctcctctctctcgactctgagcgggctggcaaggcgcatagnnn

SEQ ID NO: 173680 - DNA, 592 bp, Homo sapiens
  misc_feature: GYAE6OF01AEDUA.49.65.F10.1.454.CMB.1.raw
  modified_base (151)..(151): a, c, t, g, unknown or other
  misc_feature (151)..(151): n is a, c, g, or t
  modified_base (294)..(294): a, c, t, g, unknown or other
  misc_feature (294)..(294): n is a, c, g, or t
  modified_base (464)..(464): a, c, t, g, unknown or other
  misc_feature (464)..(464): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcgtggttttcncgttagctctttaagaggtgtccagtgtcaggtgcagctggtggagtcgtggggggaggcgtggtccagcctggggaggtccctgagactctcctgtgaagcctctggattcaccttcaagactttggcatgcactgggtccnccaggctccgaggcacggggctgggagtgggtggcagttatctcagatgataggaaagtaaaagtctattcggacttcgttaggaacgggcctattccacctatcctacagagacaattccaagaacaccttagacactactaacaatcgacacagtctagacgtaccgngacggacgacggtctagtcgtattacgtggtacggacgggtaagggggtaggggttagttttacggcgttacggttacggtacccgtacgttacggtaccgtacggtcggggtcccggtaacccgggg

SEQ ID NO: 173681 - DNA, 257 bp, Homo sapiens
  misc_feature: GYAE6OF01CITRA.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgactctgagcgggctggcaaggcgcatagnnnn

SEQ ID NO: 173682 - DNA, 259 bp, Homo sapiens
  misc_feature: GYAE6OF01CLPKW.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccaccctcctctctctcgactctgagcgggctggcaaggcgcatagnnnnn

SEQ ID NO: 173683 - DNA, 299 bp, Homo sapiens
  misc_feature: GYAE6OF01B32PN.49.65.F10.1.454.CMB.1.raw
  modified_base (284)..(284): a, c, t, g, unknown or other
  misc_feature (284)..(284): n is a, c, g, or t
  modified_base (290)..(299): a, c, t, g, unknown or other
  misc_feature (290)..(299): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggaggaccaagctgaccgtcctaggtcagcccaaggctcgccccctggtcactctcgttccccgccctcctctctctcgactctgagcgggctggcaaggcncatagnnnnnnnnnn

SEQ ID NO: 173684 - DNA, 255 bp, Homo sapiens
  misc_feature: GYAE6OF01DOXMK.49.65.F10.1.454.CMB.1.raw
  modified_base (247)..(247): a, c, t, g, unknown or other
  misc_feature (247)..(247): n is a, c, g, or t
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtcactctgttccccgccctcctctctctcgactctgagcgggctggcaaggcncatagnnn

SEQ ID NO: 173685 - DNA, 589 bp, Homo sapiens
  misc_feature: GYAE6OF01CBCZ6.49.65.F10.1.454.CMB.1.raw
  modified_base (105)..(105): a, c, t, g, unknown or other
  misc_feature (105)..(105): n is a, c, g, or t
  modified_base (132)..(132): a, c, t, g, unknown or other
  misc_feature (132)..(132): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagagtcgagagacacgaccggtgctcgatttagctacgctctaagggacgacggccaccctgaccatcagcaggtcgaagccgggatgaggccgactattacngtcacgtgtgggacagtagtagtgatnatgtaggtgttcgggcggagggaccaagctgaccgtcctaggtcacgcccaaggctgtcccccgtggtcactccttcgttacccgccttccgtctctcgacgaacgtctgacgcggtctggacaaggtcgcaagagcatcgncgtnacnacnaancgacnctgcgacacgcgtccgcgtagcgtcgtacgtacgtacgtacgtacgtacgtaccgtcgtacgtacgtacgtacgtacgtacgacggtacgtacgacgacgacgacgtacgtacgtacgtagtacgtaacgtaacgacgagagtacgagagagtagtagtagtagtagtacgtacagacgacgtacgacgtacgtacgtacgtactacgtacgtacgtacgtacgacgacgacgtacgtagtacgagacgtacgtagtacgtcgacgtacacgtacgtacgtagtcgtcgtacgtacg

SEQ ID NO: 173686 - DNA, 254 bp, Homo sapiens; identical to SEQ ID NO: 173655
  misc_feature: GYAE6OF01CM86D.49.65.F10.1.454.CMB.1.raw
  modified_base (254)..(254): a, c, t, g, unknown or other
  misc_feature (254)..(254): n is a, c, g, or t

SEQ ID NO: 173687 - DNA, 252 bp, Homo sapiens
  misc_feature: GYAE6OF01EDW38.49.65.F10.1.454.CMB.1.raw
  modified_base (252)..(252): a, c, t, g, unknown or other
  misc_feature (252)..(252): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctctctctctcgactctgagcgggctggcaaggcgcatagn

SEQ ID NO: 173688 - DNA, 293 bp, Homo sapiens
  misc_feature: GYAE6OF01E2ED5.49.65.F10.1.454.CMB.1.raw
  modified_base (290)..(293): a, c, t, g, unknown or other
  misc_feature (290)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnnnn

SEQ ID NO: 173689 - DNA, 253 bp, Homo sapiens
  misc_feature: GYAE6OF01CWD30.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcggctggcaaggcgcatgn

SEQ ID NO: 173690 - DNA, 254 bp, Homo sapiens
  misc_feature: GYAE6OF01C149O.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccgccctcctctctctcgactctgagcgggctggcaggcgcatgnn

SEQ ID NO: 173691 - DNA, 260 bp, Homo sapiens
  misc_feature: GYAE6OF01EIZFC.49.65.F10.1.454.CMB.1.raw
  modified_base (254)..(260): a, c, t, g, unknown or other
  misc_feature (254)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnnnnnnn

SEQ ID NO: 173692 - DNA, 649 bp, Homo sapiens
  misc_feature: GYAE6OF01BHO9Q.49.65.F10.1.454.CMB.1.raw
  modified_base (349)..(349): a, c, t, g, unknown or other
  misc_feature (349)..(349): n is a, c, g, or t
  modified_base (471)..(471): a, c, t, g, unknown or other
  misc_feature (471)..(471): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcggtggtttcgtcgtaggctctttaagaggtgtcagtgtcaggtgcagctggtggagtcgtgggggagcgtggtccagcctggggaggtccctgagctctcctgtgaagcctgtggattcaccttcaagtactttggcatgcactcgggtccgccaggcctccgagggccgacgggggctgggaggttggggcgcgtaggttatcctanagagtgagtaggaaaagtaaaagtctagttcggacttcgtaggaagggccctattccacctatcctaccgagtaacgactaacttaccaaacgtaacctaccttagacctactaccgtaaanaactcgactacgtagtacgtacgaacgtacgtaggacgtaccgtacggtcgttagttacgttaacgttacgttagggtacgggtagggggtaagggggttggtttagtttacggtacgttacgttaccggtacccgttacgttacgtacggttacgggtccgggacccggtaaccggg

SEQ ID NO: 173693 - DNA, 279 bp, Homo sapiens
  misc_feature: GYAE6OF01B5B6Q.49.65.F10.1.454.CMB.1.raw
  modified_base (255)..(279): a, c, t, g, unknown or other
  misc_feature (255)..(279): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnnnnnnnnnnnnnnnnnnnnnnn

SEQ ID NO: 173694 - DNA, 256 bp, Homo sapiens; identical to SEQ ID NO: 173568
  misc_feature: GYAE6OF01C48RE.49.65.F10.1.454.CMB.1.raw
  modified_base (255)..(256): a, c, t, g, unknown or other
  misc_feature (255)..(256): n is a, c, g, or t

SEQ ID NO: 173695 - DNA, 331 bp, Homo sapiens
  misc_feature: GYAE6OF01ADHW1.49.65.F10.1.454.CMB.1.raw
  modified_base (264)..(265): a, c, t, g, unknown or other
  misc_feature (264)..(265): n is a, c, g, or t
  modified_base (268)..(331): a, c, t, g, unknown or other
  misc_feature (268)..(331): n is a, c, g, or t
tcagagtcgagagacacgaccggtgctcgatttagctacgctctaagggacgtacgggccaaccctgaccatcagccagggtcgaaagccggggatgacggccgactattactgtcacgtgtgggacagtagtagtgatcatgtggtgttcggcggagggaccaagctgaccgtcctaggtcagcccaaggctgccccctggtcactctgttcccgccctcctctctctcgactctggagcgggctggacaaggcgcatagcannacnnnnnnnnnnnnnnnnnnnnnnnnnnnnnnnnnnnnnnnnnnnnnnnnnnnnnnnnnnnnnnnn

SEQ ID NO: 173696 - DNA, 257 bp, Homo sapiens
  misc_feature: GYAE6OF01C44RJ.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccatcctctctctcgactctgagcgggctggcaaggcgcatagnnnn

SEQ ID NO: 173697 - DNA, 254 bp, Homo sapiens; identical to SEQ ID NO: 173532
  misc_feature: GYAE6OF01B0PAO.49.65.F10.1.454.CMB.1.raw
  modified_base (253)..(254): a, c, t, g, unknown or other
  misc_feature (253)..(254): n is a, c, g, or t

SEQ ID NO: 173698 - DNA, 253 bp, Homo sapiens
  misc_feature: GYAE6OF01BAM54.49.65.F10.1.454.CMB.1.raw
  modified_base (245)..(245): a, c, t, g, unknown or other
  misc_feature (245)..(245): n is a, c, g, or t
  modified_base (251)..(253): a, c, t, g, unknown or other
  misc_feature (251)..(253): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggaggaccaagctgaccgtctaggtcagcccaaggctgccccctggtcactctgttcccaccctctctctctcgactctgagcgggctggcaaggcncatagnnn

SEQ ID NO: 173699 - DNA, 257 bp, Homo sapiens
  misc_feature: GYAE6OF01DXFFK.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggccaaggcgcatagnnnn

SEQ ID NO: 173700 - DNA, 266 bp, Homo sapiens
  misc_feature: GYAE6OF01DUMAR.49.65.F10.1.454.CMB.1.raw
  modified_base (251)..(266): a, c, t, g, unknown or other
  misc_feature (251)..(266): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctcggtcactctgttcccgccctcctctctctcgactctgagcggctggcaagcgcatgnnnnnnnnnnnnnnnn

SEQ ID NO: 173701 - DNA, 553 bp, Homo sapiens
  misc_feature: GYAE6OF01BNN2N.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagccccgggaggtccctgagactctcctgtgaagcctctggattcaccttcaagaactttggcatgcactgggtccgccaggctcaggcacggggctgggagtgggtggcagttatctcagatgatggaagtaaaagtactattcggactcttgagggcatcacatctcagagacaatccaagaacacttgactatctaacaaatgacacagtctgagaccgtagaggaccacggctgttgtattacgtgtggacggtaaggggggaggggtagtttttggacgtgttcggaccctacgttacgtacgttacgtcggggtccgacggggtaacccg

SEQ ID NO: 173702 - DNA, 265 bp, Homo sapiens
  misc_feature: GYAE6OF01CEA1C.49.65.F10.1.454.CMB.1.raw
  modified_base (252)..(265): a, c, t, g, unknown or other
  misc_feature (252)..(265): n is a, c, g, or t
tcagagtcgagagacacgaccggtgctcgatttagctacgctctaagggacacggccaccctgaccatcagcagggtcgaagccggggatgaggccgactattactgtcacgtgtggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnnnnnnn

SEQ ID NO: 173703 - DNA, 256 bp, Homo sapiens; identical to SEQ ID NO: 173592
  misc_feature: GYAE6OF01C60BK.49.65.F10.1.454.CMB.1.raw
  modified_base (253)..(256): a, c, t, g, unknown or other
  misc_feature (253)..(256): n is a, c, g, or t

SEQ ID NO: 173704 - DNA, 281 bp, Homo sapiens
  misc_feature: GYAE6OF01C9Y3Q.49.65.F10.1.454.CMB.1.raw
  modified_base (262)..(281): a, c, t, g, unknown or other
  misc_feature (262)..(281): n is a, c, g, or t
tcagagtcgagagacacgaccggtgctcgatttagctacgctctaagggacacggccaccctgaccatcagcaggtcgaagccgggatgaggccgactattactgtcacgtgtgggacagtagtagtgatcatgtggtgttcggcggagggaccaagctgaccgtcctaggtcagcccaaggctgcccccctggtcactctgttccccgcccttccctctcctcgtcgactcctgaagcgggtctgggcaaggcgcaatagnnnnnnnnnnnnnnnnnnnn

SEQ ID NO: 173705 - DNA, 258 bp, Homo sapiens
  misc_feature: GYAE6OF01ESBSY.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacacgtagtagtgatcatgtggtgttcggcggagggaccaagctgaccgtcctaggtcagcccaaggctgccccctggtcactctgttcccacctcctctctctcgactctgagcgggctggcaaggcgcatagnnnnnn

SEQ ID NO: 173706 - DNA, 298 bp, Homo sapiens
  misc_feature: GYAE6OF01DU5K8.49.65.F10.1.454.CMB.1.raw
  modified_base (252)..(252): a, c, t, g, unknown or other
  misc_feature (252)..(252): n is a, c, g, or t
  modified_base (257)..(298): a, c, t, g, unknown or other
  misc_feature (257)..(298): n is a, c, g, or t
tcagagtcgagagacacgaccggtgctcgatttagctacgctctaaggacacggccaacccgtgaccatcacgcagggtcgaagccggggatgaggccgactattactggtccacgtgtgggaccagtaggtagtgatcatgtggtgttcggcggaggaccaagctgaccgtctaggtcagcccaaggctgccccctggtccactctcgttccccacctcctctctctcgactctgagcggctggcaggcgnatagnnnnnnnnnnnnnnnnnnnnnnnnnnnnnnnnnnnnnnnnnn

SEQ ID NO: 173707 - DNA, 272 bp, Homo sapiens
  misc_feature: GYAE6OF01CIMJ2.49.65.F10.1.454.CMB.1.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (253)..(272): a, c, t, g, unknown or other
  misc_feature (253)..(272): n is a, c, g, or t
tcagagtcgagagacacgaccggtgctcgatttagctacgctctaagggacacggccgaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctctctactctcgactctgagcgggntggcaaggcncatagnnnnnnnnnnnnnnnnnnnn

SEQ ID NO: 173708 - DNA, 269 bp, Homo sapiens
  misc_feature: GYAE6OF01BQKM4.49.65.F10.1.454.CMB.1.raw
  modified_base (254)..(269): a, c, t, g, unknown or other
  misc_feature (254)..(269): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnnnnnnnnnnnnnn

SEQ ID NO: 173709 - DNA, 567 bp, Homo sapiens
  misc_feature: GYAE6OF01BC59R.49.65.F10.1.454.CMB.1.raw
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagtaacctttggcatgcactgggtcccgccaggcctccaggcacggggctgggagtgggtggctagttatctcagatgatggaaagtaaaagtctattcggactccgttggaaggccattcacntctcaganacactaccaagaacaccttgacatactaacaaatcgacacagtactgacgacctagacggacacggcgttgtgtagttacgtgtggacgggaaggggggtagggtaggtttttggcgtaggttcggaccctacgttagaccgttacggtcggggtaccgtaaccgggg

SEQ ID NO: 173710 - DNA, 256 bp, Homo sapiens; identical to SEQ ID NO: 173490
  misc_feature: GYAE6OF01BECPJ.49.65.F10.1.454.CMB.1.raw
  modified_base (254)..(256): a, c, t, g, unknown or other
  misc_feature (254)..(256): n is a, c, g, or t

SEQ ID NO: 173711 - DNA, 354 bp, Homo sapiens
  misc_feature: GYAE6OF01EHAI6.49.65.F10.1.454.CMB.1.raw
  modified_base (153)..(153): a, c, t, g, unknown or other
  misc_feature (153)..(153): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (265)..(266): a, c, t, g, unknown or other
  misc_feature (265)..(266): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (281)..(354): a, c, t, g, unknown or other
  misc_feature (281)..(354): n is a, c, g, or t
tcagagtcgagagacacgaccggtgctcgatttagctacgctctaagggacgacggccaaccctgaccatcagccagggtcgaagacccggggatgaggccgactattactgtcacgtgtgggaccagtagtagtgatcatgtggtgttcggnggagggaccaagctgaccgtcctaggtcagcccaaggctgccccctggtcactctcgttccccaccctctcnctcncgactcctggagcgggtctggcaaggcgacattagnntcatncngatcatcnnnnnnnnnnnnnnnnnnnnnnnnnnnnnnnnnnnnnnnnnnnnnnnnnnnnnnnnnnnnnnnnnnnnnnnnnn

SEQ ID NO: 173712 - DNA, 255 bp, Homo sapiens; identical to SEQ ID NO: 173578
  misc_feature: GYAE6OF01DH2OR.49.65.F10.1.454.CMB.1.raw
  modified_base (254)..(255): a, c, t, g, unknown or other
  misc_feature (254)..(255): n is a, c, g, or t

SEQ ID NO: 173713 - DNA, 737 bp, Homo sapiens
  misc_feature: GYAE6OF01D6L98.49.65.F10.1.454.CMB.1.raw
  modified_base (296)..(296): a, c, t, g, unknown or other
  misc_feature (296)..(296): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggtattcaccttcaagtaactttggcatgcacgtgggtccnccaggctccgagggcgacggggctgggagtggggtgcagttatctacgagatggataggtaaaagttaaaaagtacttaagtttccggaacttcccgttaggaaacggggtcccgtaatttacccaaccctaattccctacccgtaacggtaacgaacctaaactttacccaaacgtaaacccaaccgtttacgacctaactaccttaaactaaactacgactaacctaagtaccgtagaacggtaacccgtagggaacgggtaaccgtaaccgggtcttaggttacggtttaacgttaccgttaggtacgggtaacggggttaaagggggggggtaggggttaagttttttcgggaccgttaacggtttaccggggtaaccccgttaccggtttacggtaaccgttaccgggttaccgggggacccggtaaacccggggg

SEQ ID NO: 173714 - DNA, 257 bp, Homo sapiens
  misc_feature: GYAE6OF01DOWP6.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnnn

SEQ ID NO: 173715 - DNA, 260 bp, Homo sapiens
  misc_feature: GYAE6OF01BOE77.49.65.F10.1.454.CMB.1.raw
  modified_base (253)..(260): a, c, t, g, unknown or other
  misc_feature (253)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnn

SEQ ID NO: 173716 - DNA, 285 bp, Homo sapiens
  misc_feature: GYAE6OF01AN30Z.49.65.F10.1.454.CMB.1.raw
  modified_base (244)..(244): a, c, t, g, unknown or other
  misc_feature (244)..(244): n is a, c, g, or t
  modified_base (249)..(285): a, c, t, g, unknown or other
  misc_feature (249)..(285): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtctaggtcagcccaaggctgccccctggtcactctgttcccgccctctctctctcgactctgagcggctggcaaggcgnatagnnnnnnnnnnnnnnnnnnnnnnnnnnnnnnnnnnnnn

SEQ ID NO: 173717 - DNA, 293 bp, Homo sapiens
  misc_feature: GYAE6OF01CFTHL.49.65.F10.1.454.CMB.1.raw
  modified_base (290)..(293): a, c, t, g, unknown or other
  misc_feature (290)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcctgccccctggtcactctgttcccgccctcctctctctcgactctgagcgggctggcaaggcgcatagcnnnn

SEQ ID NO: 173718 - DNA, 257 bp, Homo sapiens
  misc_feature: GYAE6OF01DEB3O.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtaatagtgatcatgtggtgttcggcggagggaccaagctgaccgtcctaggtcagcccaaggctgccccctggtcactctcgttcccaccctcctctctctcgactctgagcgggctggcaaggcgcatgnnnnn

SEQ ID NO: 173719 - DNA, 705 bp, Homo sapiens
  misc_feature: GYAE6OF01EKC9O.49.65.F10.1.454.CMB.1.raw
  modified_base (314)..(314): a, c, t, g, unknown or other
  misc_feature (314)..(314): n is a, c, g, or t
tcagagtcgagagacacgaccggtgctcgatttagctacgctctaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccagccgtggggacggtccctggagactctcctggtcgaacgccttctggtacttcacctttcaaagtaactttggctatcgcgtacgtgggtcccnccgaggcctccgaggccgacgggggctagggaggtgggtgcgtagttactctacgagataggaagtaggtaaagttaaaagtcttaagttccggtactccgttaggaacgggtcctaacttaccgacctagtacctacgagtaacaacgtaacttaccgaaacgtaacctaccttacgactaacttacctaaactaaactacgacctaacgtacgtactaggacgtacgtacggaacggaccgtacgggtcttacggtagttaacttaggtacggttcgggaacgggttaaaggggggtcgggtttattttacgggacgttaacggttcggtaacccccgttagttaccggtaaccggttacgggtaccgggggacccgtaaacccggggg

SEQ ID NO: 173720 - DNA, 295 bp, Homo sapiens
  misc_feature: GYAE6OF01BRARK.49.65.F10.1.454.CMB.1.raw
  modified_base (260)..(263): a, c, t, g, unknown or other
  misc_feature (260)..(263): n is a, c, g, or t
  modified_base (265)..(295): a, c, t, g, unknown or other
  misc_feature (265)..(295): n is a, c, g, or t
tcagagtcgagagacacgaccggtgctcgatttagctacgctctaagggacgacgggccaccctgaccatcagcagggtcgaagccggggatgaggccgactattactgtcacggtgtgggacagtagtagtgatcatgtggtgttcgggcggagggaccaagcttgaccgtctaggtcagcccaaggctgccccctggtcactctgttcccgccctcctcgtctctcgactcgtggagcgggctggcaaggcgcatagnnnntnnnnnnnnnnnnnnnnnnnnnnnnnnnnnnn

SEQ ID NO: 173721 - DNA, 536 bp, Homo sapiens
  misc_feature: GYAE6OF01DDEPX.49.65.F10.1.454.CMB.1.raw
  modified_base (296)..(296): a, c, t, g, unknown or other
  misc_feature (296)..(296): n is a, c, g, or t
  modified_base (397)..(397): a, c, t, g, unknown or other
  misc_feature (397)..(397): n is a, c, g, or t
  modified_base (471)..(471): a, c, t, g, unknown or other
  misc_feature (471)..(471): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtcccagcctggggaggtccctgagactctcctgtgaagcctctggattcaccttcaagaactttggcatgcactgggtccnccaggctccaggcacggggctggagtgggtgcagttatctcagatgataggaaagtaaaaagtactattcggactccttagagggccattcacatctcagngacaatcaaagacacttgcatctacaaatcgcacagtctagacgacctgacgggacacggctgtgtattactgngcggaagggggtagggtattttggctagtcggaccctacgttgactacgtgggccgtaaaccggg

SEQ ID NO: 173722 - DNA, 262 bp, Homo sapiens
  misc_feature: GYAE6OF01CVE7S.49.65.F10.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnnnnnnnn

SEQ ID NO: 173723 - DNA, 291 bp, Homo sapiens
  misc_feature: GYAE6OF01B24WT.49.65.F10.1.454.CMB.1.raw
  modified_base (289)..(291): a, c, t, g, unknown or other
  misc_feature (289)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnn

SEQ ID NO: 173724 - DNA, 661 bp, Homo sapiens
  misc_feature: GYAE6OF01CIGG9.49.65.F10.1.454.CMB.1.raw
  modified_base (305)..(305): a, c, t, g, unknown or other
  misc_feature (305)..(305): n is a, c, g, or t
  modified_base (513)..(513): a, c, t, g, unknown or other
  misc_feature (513)..(513): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctgacgactctcctgtgaagcctcgtggattcaccttacaagtaactttggctatgcacgtcgggtcccnccgacggcctccgacgggccgacggggctgggaggtgggtggctaggttatctcgagtagtaggaagtaagggaaaagtaaaacgtcgttaacgtaccggtaacctccgttagggaacgggtccgtaacttccgaacctactccgtaccaaggactaacctaacttaaccaaacgaacctacttagacctatacctaacaactcacanacgtcagaacgtactaggacgacgacggtcttgtacgttacgttagtcggtaggaacgggggtaagggggtaggtttagttttcggacgttacggttaccggtaccgtacgttacggtaccgttacggtacggggacccgtaaccggg

SEQ ID NO: 173725 - DNA, 294 bp, Homo sapiens
  misc_feature: GYAE6OF01AP379.49.65.F10.1.454.CMB.1.raw
  modified_base (288)..(294): a, c, t, g, unknown or other
  misc_feature (288)..(294): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnn

SEQ ID NO: 173726 - DNA, 256 bp, Homo sapiens
  misc_feature: GYAE6OF01EC7CR.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcggctggcaaggcgcatagnnnn

SEQ ID NO: 173727 - DNA, 768 bp, Homo sapiens
  misc_feature: GYAE6OF01BF438.49.65.F10.1.454.CMB.1.raw
  modified_base (149)..(149): a, c, t, g, unknown or other
  misc_feature (149)..(149): n is a, c, g, or t
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (302)..(302): a, c, t, g, unknown or other
  misc_feature (302)..(302): n is a, c, g, or t
tcagagtcgagagacacgaccggtgctcgatttagctacgctctaaggggggagaggagcccagcactagaagtcggcggtgttccattcggtgatcagcactgaacacagaggactcaccatggagtttgggctgagctgggtttccngtgctctttaagngtgtccagtgtcaggtncagctggtgagtctggggagcgtggtccagcctggggagtccctggagacctctcctggtgaacgcctctggacttcacctttcaaggtacctttggcctaatcggactacgtggggtccccnctaagggcctaccgagggtccaacgggggtcttggggaacgttcggggtcggactacgggtttaactccgtacgaggtagttcggaagttacggggtaaaacgttaaaacgttccgtaagtttcccgggaacttcccggttagggaaacgggtccctaagtttcccgaaccgttaagttcccgtaccgtacggtaacgtacctaaccgttaccgaaacgtaaccgtaccgtttacgaccttacgttaccgtaacgtaaacgttcggtaaccgtacgtacggttacgtacggtaaccgtaccgttacgggaaccggtacgtaccggtacgttacggtacgttacgttaccggtacggtaccggtacgggtaacgggggtacggttagttttcggacgttacggttaccgggaaccccttacggttaccgggtaaccgttacgggtccggggtacccgtaaaccgggg

SEQ ID NO: 173728 - DNA, 263 bp, Homo sapiens
  misc_feature: GYAE6OF01C3Z8C.49.65.F10.1.454.CMB.1.raw
  modified_base (255)..(263): a, c, t, g, unknown or other
  misc_feature (255)..(263): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnn

SEQ ID NO: 173729 - DNA, 254 bp, Homo sapiens; identical to SEQ ID NO: 173462
  misc_feature: GYAE6OF01BOGSW.49.65.F10.1.454.CMB.1.raw
  modified_base (253)..(254): a, c, t, g, unknown or other
  misc_feature (253)..(254): n is a, c, g, or t

SEQ ID NO: 173730 - DNA, 705 bp, Homo sapiens
  misc_feature: GYAE6OF01C0WTZ.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagttgggctgagctgggttttcctcgttgcttctttaagaggtgtccagtgtcaggtgcagcgtggtggagtcgtgggggagcgtggtccagccgtgggacgtccctgagactctcctgtgaagtcctcgtggtacttctaccttacaacgtaacgtttggactagttcgcctacgtcgggtccgaccgacggcctaccgacggtcgacggggtctgggaggtgggtggacgtaggttatcgtcagtagtagaagtaacgggtaaaagttaaaaacgtcttaacgtacggtaacttacggttacggaaacgggtccgtaacttaccgaacctagttcctaccgaagtaacgtaacctaaacgttaacccaaagtaacctaccgttacgactactactaaaccgaatacgacctacgacgtactacggaacgtaccgtaggaacggtacctacgggtcttaggtacttaacgttacgtggtacgggtaacggggtaaaggggggttaggtttagttttacggacgttacgttacggacccttacggttagaccgttacggcgggtacccgtaacccggg

SEQ ID NO: 173731 - DNA, 735 bp, Homo sapiens
  misc_feature: GYAE6OF01CHWCC.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcggtggtccaggccgtggggacggtccctggagtacctcctcctggtgaacgccctgtggattccaccttcaagtaactttggcatgccacgtgggtcccgccaggcctccgagggccgacgggggctgggaggtggggtggctagttactctacagatggaagtagggtaaaaagttaaaacgtcttacgttacggaccttaccgttagggaacgggaccctatttcccaaccgtacttacccgtaccgaaggacgtaaacctaaactttacccaaaacgtaaaccctacccgttagacctaacttaacctaaaccgtaaaacgtcgaaccaaccgtaagtaccgtaggaacccgtaacccgtaggaaaccgggtaccgtaccgggtcttaggtacgttaagtttaccgtgggtacgggacgggggtaaaggggggtacgggtttagttttcgggacgttacgttaccgggtaacccctagtttacggaaccgttaccgggtccggggaccgtaacccggggg

SEQ ID NO: 173732 - DNA, 694 bp, Homo sapiens
  misc_feature: GYAE6OF01CP4B7.49.65.F10.1.454.CMB.1.raw
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccagccgtggggacgtccctgacgactctccgtgtagacgcctgtggattccacctttanaaagtaactttggctagtcgcacgtcgggtccnccgagggcctccgagggccgacgggggtctgggacggtggggtagctaaggtttacnctacgagataggaagtaaggaaaagttaaaaagtcttaagttccggtaacttccgttaaggaacgggtccgtaatttccaacctattcctaccgaagactaacctaacttaccaaagaacctactacgactaactactaacaaatcgaccacgagtactagaacgaaccgtaggaacggtacgacggtacttaggtagttaattacggtggtacgggtacggggaaggggggttaacgggtttagtttttacggacgttacggttacggaacccgttacgttaggtacccggttaacgggttaccgggggaccgtaaacccgggg

SEQ ID NO: 173733 - DNA, 273 bp, Homo sapiens
  misc_feature: GYAE6OF01CNFSB.49.65.F10.1.454.CMB.1.raw
  modified_base (249)..(249): a, c, t, g, unknown or other
  misc_feature (249)..(249): n is a, c, g, or t
  modified_base (255)..(273): a, c, t, g, unknown or other
  misc_feature (255)..(273): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggtcactctgttcccaccctcctctctctcgactctgagcgggctggcaaggcncatagnnnnnnnnnnnnnnnnnnn

SEQ ID NO: 173734 - DNA, 257 bp, Homo sapiens
  misc_feature: GYAE6OF01DS2DX.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctctctctctcgactctgagcggctggcaaggcgcatagnnnnn

SEQ ID NO: 173735 - DNA, 358 bp, Homo sapiens
  misc_feature: GYAE6OF01BU48Y.49.65.F10.1.454.CMB.1.raw
  modified_base (292)..(293): a, c, t, g, unknown or other
  misc_feature (292)..(293): n is a, c, g, or t
  modified_base (295)..(295): a, c, t, g, unknown or other
  misc_feature (295)..(295): n is a, c, g, or t
  modified_base (298)..(358): a, c, t, g, unknown or other
  misc_feature (298)..(358): n is a, c, g, or t
tcagagtcgagagacacgaccggtgctcgatttagctacgctctaaggggcgacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtctaggtcagcccaaggctcgccccctggtcactctgttccccaccctcctctctctcgactctgagcgggctggcaaggcgacatagnnancgnnnnnnnnnnnnnnnnnnnnnnnnnnnnnnnnnnnnnnnnnnnnnnnnnnnnnnnnnnnnn

SEQ ID NO: 173736 - DNA, 282 bp, Homo sapiens
  misc_feature: GYAE6OF01BBE0I.49.65.F10.1.454.CMB.1.raw
  modified_base (250)..(250): a, c, t, g, unknown or other
  misc_feature (250)..(250): n is a, c, g, or t
  modified_base (256)..(282): a, c, t, g, unknown or other
  misc_feature (256)..(282): n is a, c, g, or t
tcagagtcgagagacacgaccggtgctcgatttagctacgctctaagggacacggccaccctgaccatcgagcagggtcgaagccggggatgaggccgactattactgtcacgtgtgggacagtagtagtgatcatgtggtgttcggcggagggaccaagctgaccgtcctaggtcagcccaaggctgccccctggtcacgtctgttcccaccctcctctctctcgactctgagcgggctggctaaggcncatagnnnnnnnnnnnnnnnnnnnnnnnnnnn

SEQ ID NO: 173737 - DNA, 557 bp, Homo sapiens
  misc_feature: GYAE6OF01BL0SJ.49.65.F10.1.454.CMB.1.raw
  modified_base (388)..(388): a, c, t, g, unknown or other
  misc_feature (388)..(388): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagtaactttggcatgcactgggtccgccaggcctccgaggcacgggggctgggagtgggtggcagttatctcagatgatggaaagtaaaagtctatcggactcctgaggcattcacatcncagagacattccaagaacacctgcatctaacaatgcacatactgagacctggacggacacggtctggtagttagttacgtggtcggacgggtaaggggggtaggggttagtttttcggcgttagttcggaccctacgttacgacgttacggtcggggccgtaaccgggg

SEQ ID NO: 173738 - DNA, 258 bp, Homo sapiens
  misc_feature: GYAE6OF01EPLEG.49.65.F10.1.454.CMB.1.raw
  modified_base (256)..(258): a, c, t, g, unknown or other
  misc_feature (256)..(258): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnnn

SEQ ID NO: 173739 - DNA, 254 bp, Homo sapiens
  misc_feature: GYAE6OF01ECDS7.49.65.F10.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcggctggcaaggcgcatagnnnn

SEQ ID NO: 173740 - DNA, 258 bp, Homo sapiens
  misc_feature: GYAE6OF01EIO2A.49.65.F10.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctctctctctcgactctgagcgggctggcaaggcgcatagnnnnnnn

SEQ ID NO: 173741 - DNA, 547 bp, Homo sapiens
  misc_feature: GYAE6OF01BZPCH.49.65.F10.1.454.CMB.1.raw
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagccgtgggaggtccctgagactctcctgtgaagcctctggacttcaccttcaagtaactttggcatgcacgtcggggtcccgccgaggcctccgagggcgaccggggctgggaggtggggtggctagttactctacagatgagtaggaaagtaaaagtactatcggactctagacggctatcacatcncananacatcaagaacactnacactntacaatncanatcngagacctgacgacacgctgtntatcgtgtggaggtagggggtagggttagtttggcgtagttcggaccgtcgttagacgtacggtgggccgtaacggg

SEQ ID NO: 173742 - DNA, 258 bp, Homo sapiens
  misc_feature: GYAE6OF01DCK63.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcggctggcaaggcgcatagnnnnn

SEQ ID NO: 173743 - DNA, 830 bp, Homo sapiens
  misc_feature: GYAE6OF01CBSOA.49.65.F10.1.454.CMB.1.raw
  modified_base (256)..(256): a, c, t, g, unknown or other
  misc_feature (256)..(256): n is a, c, g, or t
tcagagtcgagagacacgaccggtgctcgatttagctacgctctaagggggggagaggagcccagcactagaagtcggcggtgtttccattcggtgatcagcactgaacacagagactcaccatggagtttgggctgagctgggttttcctcgttgctcttttaagaggtgtccagtgtcaggtgcagctggtggagtcgtgggggaggcgtggtccagccgtggggacgtccctgagtctctcctgtgaagcctntggattccaccttcaagtaactttggctatgcacgtcgggtcccgccgacggcctccgagggccgacggggcgtagggaggtgggtcggctagtttacgtcgtacgaaggtataggtaagtaaggggtaaaaagttaaaaaacggttacgttacggtttaccggtaaccgtttacccggtttaaggggaaccggggtacccgttaagttttaaccccgaaccccgtaactttcccgtaacccgtaacggaaacgtaaacccgtaaaccttaacccgtaaaaccgtaaaccctaacccgtttacggaacccttaacgttaaccctaaaaccgtaaaacttcggaacccaaacgtacgttaccgtacgtaaccggtaacccgtacgggaaccgggtaaccgaaccgggttcttacggttacgtttaacgttaaccggtgggttaacgggtaccggggggtaaaggggggttacggggtttaacgtttttacggacgtttaacgggtttacccgtaacccgttacggtttacggaacccggtttaacgggtccggggtacccggtaaaccccggggg

SEQ ID NO: 173744 - DNA, 313 bp, Homo sapiens
  misc_feature: GYAE6OF01DPXVO.49.65.F10.1.454.CMB.1.raw
  modified_base (294)..(313): a, c, t, g, unknown or other
  misc_feature (294)..(313): n is a, c, g, or t
tcagagtcgagagacacgaccggtgctcgatttagctacgctctaagggcacgaccggtagctcgatttagctacgctctagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgacgcgggcctggcaaggcgcataggcnnnnnnnnnnnnnnnnnnnn

SEQ ID NO: 173745 - DNA, 259 bp, Homo sapiens
  misc_feature: GYAE6OF01BUW7R.49.65.F10.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtcactctcgttcccacctcctctctctcgactctgaggcgggctggcaaggcgcatagnnnnnnn

SEQ ID NO: 173746 - DNA, 297 bp, Homo sapiens
  misc_feature: GYAE6OF01CIETH.49.65.F10.1.454.CMB.1.raw
  modified_base (290)..(297): a, c, t, g, unknown or other
  misc_feature (290)..(297): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccgccctcctctctctcgactctgagcgggctggcaaggcgcatagnnnnnnnn

SEQ ID NO: 173747 - DNA, 281 bp, Homo sapiens
  misc_feature: GYAE6OF01BANX5.49.65.F10.1.454.CMB.1.raw
  modified_base (249)..(249): a, c, t, g, unknown or other
  misc_feature (249)..(249): n is a, c, g, or t
  modified_base (254)..(281): a, c, t, g, unknown or other
  misc_feature (254)..(281): n is a, c, g, or t
tcagagtcgagagacacgaccggtgctcgatttagctacgctctaagggacacgggccaccctgacccatcagcagggtcgaagccggggatgaggccgactattactgtcacgtgtggggacagtagtagtgatcatgtggtgttcggcggagggaccaagctgaccgtcctaggtcagcccaaggctgccccctggtcactctgttccccgcctctctctctcgactctgagcgggctggcaaggcncatgnnnnnnnnnnnnnnnnnnnnnnnnnnnn

SEQ ID NO: 173748 - DNA, 258 bp, Homo sapiens
  misc_feature: GYAE6OF01C9XGD.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcggctggcaaggcgcatagnnnnnn

SEQ ID NO: 173749 - DNA, 266 bp, Homo sapiens
  misc_feature: GYAE6OF01DR3KY.49.65.F10.1.454.CMB.1.raw
  modified_base (240)..(240): a, c, t, g, unknown or other
  misc_feature (240)..(240): n is a, c, g, or t
  modified_base (256)..(266): a, c, t, g, unknown or other
  misc_feature (256)..(266): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccaccctcctctctctcgactctggagcggntggacaaggcgcatgnnnnnnnnnnn

SEQ ID NO: 173750 - DNA, 257 bp, Homo sapiens; identical to SEQ ID NO: 173534
  misc_feature: GYAE6OF01BQLN6.49.65.F10.1.454.CMB.1.raw
  modified_base (254)..(257): a, c, t, g, unknown or other
  misc_feature (254)..(257): n is a, c, g, or t

SEQ ID NO: 173751 - DNA, 271 bp, Homo sapiens
  misc_feature: GYAE6OF01CW96E.49.65.F10.1.454.CMB.1.raw
  modified_base (257)..(271): a, c, t, g, unknown or other
  misc_feature (257)..(271): n is a, c, g, or t
tcagagtcgagagacacgaccggtgctcgatttagctacgctctaagggacatggccaccctgaccatcagcagggtcgaagccggggatgaggccgactattactgtcacgtgtgggacgtaggtagtagtgatcatgtggtgttcggcggagggaccaagcctgaccgtctaggcagcccaaggctgccccctggtcactctgttccccgcctcctctctctcgactctgacgcggctaggcaaggccgcatagnnnnnnnnnnnnnnn

SEQ ID NO: 173752 - DNA, 306 bp, Homo sapiens
  misc_feature: GYAE6OF01A4F3E.49.65.F10.1.454.CMB.1.raw
  modified_base (254)..(256): a, c, t, g, unknown or other
  misc_feature (254)..(256): n is a, c, g, or t
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (273)..(306): a, c, t, g, unknown or other
  misc_feature (273)..(306): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccacctctctctctcgactctgagcgggctggcaaggcacatagnnnancnntgcatgatccgnnnnnnnnnnnnnnnnnnnnnnnnnnnnnnnnnn

SEQ ID NO: 173753 - DNA, 264 bp, Homo sapiens
  misc_feature: GYAE6OF01CDO8J.49.65.F10.1.454.CMB.1.raw
  modified_base (258)..(264): a, c, t, g, unknown or other
  misc_feature (258)..(264): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttcccaccctcctctctctcgactctgagcgggctgggcaaggcgcaatagnnnnnnn

SEQ ID NO: 173754 - DNA, 257 bp, Homo sapiens
  misc_feature: GYAE6OF01C2DKD.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcgggctggcaaggcgcatagnnnnn

SEQ ID NO: 173755 - DNA, 292 bp, Homo sapiens
  misc_feature: GYAE6OF01BU2GH.49.65.F10.1.454.CMB.1.raw
  modified_base (291)..(292): a, c, t, g, unknown or other
  misc_feature (291)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccctcggtcactctcgttccccaccctcctctctctcgactctgagcgggctggcaaggcgcatagnn

SEQ ID NO: 173756 - DNA, 261 bp, Homo sapiens
  misc_feature: GYAE6OF01AM71E.49.65.F10.1.454.CMB.1.raw
  modified_base (254)..(261): a, c, t, g, unknown or other
  misc_feature (254)..(261): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnnnnnnnn

SEQ ID NO: 173757 - DNA, 259 bp, Homo sapiens
  misc_feature: GYAE6OF01D9Y6G.49.65.F10.1.454.CMB.1.raw
  modified_base (254)..(259): a, c, t, g, unknown or other
  misc_feature (254)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctcggtcactctcgttccccgcctcctctctctcgactctgagcgggctggcaaggcgcatagnnnnnn

SEQ ID NO: 173758 - DNA, 617 bp, Homo sapiens
  misc_feature: GYAE6OF01EI858.49.65.F10.1.454.CMB.1.raw
  modified_base (461)..(461): a, c, t, g, unknown or other
  misc_feature (461)..(461): n is a, c, g, or t
tcagagtcgagagacacgaccggtgctcgatttagctacgctctaagggggggagaggagcccagcactagaagtcggcggtgtttccattcggtgatcagcactgaacacagagactcaccatggagtttgggctgagcttgggttttcctcgttgcttcttttaagaggtgtccagtgtcaggtgcagctgggtggagtcgtgggggaggcgtggtccagccgtggggagtccctgacgactctcctgtgaacgcctctggtacttccaccttcaaagtaactttggcatgcacgtcgggtccgccaggctccgaggcgacggggctgggaggtggggtgctagttatcgtacgagtatgaagtaggtaaaagtaaaagtctagttcggacttccgttaggaacgggcctatccactatctacagacaacattaccaagacctacgtagacatactaanaactcacactacgtctagaacgacctaggacggtacgacggtcttggtagttacttagtggtaggacggggtaagggggtggtttaatttggacgttacgttaccggacccttacgttacggaccgttaccgggtacggggtaccgtaacccgggg

SEQ ID NO: 173759 - DNA, 262 bp, Homo sapiens
  misc_feature: GYAE6OF01B673E.49.65.F10.1.454.CMB.1.raw
  modified_base (257)..(262): a, c, t, g, unknown or other
  misc_feature (257)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcctcgccccctggtcactctgttccccgccctcctctcctctcgactctgagcgggctggcaaggcgcatagnnnnnn

SEQ ID NO: 173760 - DNA, 297 bp, Homo sapiens
  misc_feature: GYAE6OF01CXLHU.49.65.F10.1.454.CMB.1.raw
  modified_base (290)..(297): a, c, t, g, unknown or other
  misc_feature (290)..(297): n is a, c, g, or t
tcagagtcgagagacacgaccggtgctcgatttagctacgctctaagggcacgaccggtgctcgatttagctacgctctagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgacgcgggctggcaaggcgcatagnnnnnnnn

SEQ ID NO: 173761 - DNA, 521 bp, Homo sapiens
  misc_feature: GYAE6OF01EDWV7.49.65.F10.1.454.CMB.1.raw
  modified_base (291)..(291): a, c, t, g, unknown or other
  misc_feature (291)..(291): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactggtccnccaggctccgaggcacggggctgggagtgggtgcagttatctcagatgatggaataaaagtctatcggactctgaggcatcacatctcananacatcaanaacactgacatactacaaatgacacagtctgacgacctagacggacacgctgtagtattacgtgtggaggaaggggtagggtagttttgctagttggacccgtacttacgactacgtgggcgtaaccggg

SEQ ID NO: 173762 - DNA, 263 bp, Homo sapiens
  misc_feature: GYAE6OF01CQ63C.49.65.F10.1.454.CMB.1.raw
  modified_base (211)..(211): a, c, t, g, unknown or other
  misc_feature (211)..(211): n is a, c, g, or t
  modified_base (256)..(263): a, c, t, g, unknown or other
  misc_feature (256)..(263): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccnccctcctctctctcgactctgagcgggctggcaaggcgctatagnnnnnnnn

SEQ ID NO: 173763 - DNA, 258 bp, Homo sapiens
  misc_feature: GYAE6OF01EBZZP.49.65.F10.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctttcccaccctcctctctctcgactctgagcgggctggcaaggcgcatagnnnnnnn

SEQ ID NO: 173764 - DNA, 296 bp, Homo sapiens
  misc_feature: GYAE6OF01B50E3.49.65.F10.1.454.CMB.1.raw
  modified_base (289)..(296): a, c, t, g, unknown or other
  misc_feature (289)..(296): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctgttccccaccctctctctctcgactctgagcgggctggcaaggcgcatagnnnnnnnn

SEQ ID NO: 173765 - DNA, 258 bp, Homo sapiens
  misc_feature: GYAE6OF01BHBPF.49.65.F10.1.454.CMB.1.raw
  modified_base (255)..(258): a, c, t, g, unknown or other
  misc_feature (255)..(258): n is a, c, g, or t
tcagagtcgagagacacgaccggtgctcgatttagctacgctctaaggggacacggccaccctgaccatcagcagggtcgaagccggggatgaggccgactattactgtcacgtgtggacagtagtagtgatcatgtggtgttcggcggagggaccaagctgaccgtcctaggtcagcccaaggctgccccctcggtcactctgttccccgccctcctctctctcgactctgagcgggctggcaaggcgcatagnnnn

SEQ ID NO: 173766 - DNA, 257 bp, Homo sapiens
  misc_feature: GYAE6OF01A2CAN.49.65.F10.1.454.CMB.1.raw
  modified_base (248)..(248): a, c, t, g, unknown or other
  misc_feature (248)..(248): n is a, c, g, or t
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgcctcctctctctcgactctgagcgggctggcaaggcncatagnnnn

SEQ ID NO: 173767 - DNA, 319 bp, Homo sapiens
  misc_feature: GYAE6OF01B579P.49.65.F10.1.454.CMB.1.raw
  modified_base (257)..(257): a, c, t, g, unknown or other
  misc_feature (257)..(257): n is a, c, g, or t
  modified_base (263)..(319): a, c, t, g, unknown or other
  misc_feature (263)..(319): n is a, c, g, or t
tcagagtcgagagacacgaccggtgctcgatttagctacgctctaagggacgtacggcccacccctgaccatcagcagggtccgaagccggggatgaggcccgactattactgtcacgtggtgggacagtagtagtgatcatggtggtgttcggcggaggaccaagctgaccgtcctaggtcagcccaaggctgccccctggtctactctgttcccgccctcctctctctccgactcgtgagcgggctggcaaggcncatagnnnnnnnnnnnnnnnnnnnnnnnnnnnnnnnnnnnnnnnnnnnnnnnnnnnnnnnnn

SEQ ID NO: 173768 - DNA, 627 bp, Homo sapiens
  misc_feature: GYAE6OF01EVAED.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcgtgttccagccgtggggacggtccctgacgactctcctgtgaacgcctctggattcaccttcaagtaactttggctatcgacacgtcgggtccgccgaggcctccgaggccgacggggctgggaggtggggtcgctagttatctacgagtatgaacgtagggaaaagttaaaagtctagttcgactcgtaggaacggctatccactatcctacagacgaactaactaccaaagaacctaccttgacctacttacctaaacgaactcgacctaacacgtactacgaacgacctaggaacggacgacggtcttaggtagttacttacgtgtacgggagggtaacggggggtggtttagtttcggacgtacgttacggaccgtacgttacgtacgtacggtcgggaccgtaaccggg

SEQ ID NO: 173769 - DNA, 257 bp, Homo sapiens
  misc_feature: GYAE6OF01BYFAW.49.65.F10.1.454.CMB.1.raw
  modified_base (256)..(257): a, c, t, g, unknown or other
  misc_feature (256)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccgccctcctctctctcgactctgagcgggctggcaaggcgcatagnn

SEQ ID NO: 173770 - DNA, 259 bp, Homo sapiens; identical to SEQ ID NO: 173645
  misc_feature: GYAE6OF01AQLM2.49.65.F10.1.454.CMB.1.raw
  modified_base (253)..(259): a, c, t, g, unknown or other
  misc_feature (253)..(259): n is a, c, g, or t

SEQ ID NO: 173771 - DNA, 283 bp, Homo sapiens
  misc_feature: GYAE6OF01DTO2D.49.65.F10.1.454.CMB.1.raw
  modified_base (273)..(283): a, c, t, g, unknown or other
  misc_feature (273)..(283): n is a, c, g, or t
tcagagtcgagagacacgaccggtgctcgatttagctacgctctaagggacacggcccaccctgaccatcagcagggtcgaagccggggatgaggccgactattactgtcacgtgtgggacagtagtagtgatcatgtggtgttcggcggagggaccaagctgaccgtccgtaggtcagcccaaggcctcgcccccgtggtccacttctcgttccccaccctcctctctctcgtactcgtggacggcgggtctaggcgaacggccgacatagnnnnnnnnnnn

SEQ ID NO: 173772 - DNA, 294 bp, Homo sapiens
  misc_feature: GYAE6OF01BB865.49.65.F10.1.454.CMB.1.raw
  modified_base (258)..(263): a, c, t, g, unknown or other
  misc_feature (258)..(263): n is a, c, g, or t
  modified_base (265)..(294): a, c, t, g, unknown or other
  misc_feature (265)..(294): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagtcccaaggctgccccctggtcactctgttcccgccctcctctcgtctcgactctgagcgggctggccaaggcgcatagnnnnnngnnnnnnnnnnnnnnnnnnnnnnnnnnnnnn

SEQ ID NO: 173773 - DNA, 553 bp, Homo sapiens
  misc_feature: GYAE6OF01D09HS.49.65.F10.1.454.CMB.1.raw
  modified_base (410)..(410): a, c, t, g, unknown or other
  misc_feature (410)..(410): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (466)..(466): a, c, t, g, unknown or other
  misc_feature (466)..(466): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgaagcctctggattcaccttcaagtaactttggcatgcactgggtccgccaggctccgaggcgacggggctgggaggtggggtggctagttatctcagatgataggaaagtaaaaagtctaagttcggacttccgtagacggccgtaattcacctatctcaganacaattccaaagacactgacatactanaatgcanagtcagacgactgacgacacgntgtagttatacgtgacgacgggaggggtaggttagttttgcgtagttcggaacccgtcgttacgacttacgtggggcctaaccgggg

SEQ ID NO: 173774 - DNA, 264 bp, Homo sapiens
  misc_feature: GYAE6OF01ALBXR.49.65.F10.1.454.CMB.1.raw
  modified_base (255)..(264): a, c, t, g, unknown or other
  misc_feature (255)..(264): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccgcctcctctctctcgactctgagcgggctggcaaggcgcatagnnnnnnnnnn

SEQ ID NO: 173775 - DNA, 252 bp, Homo sapiens
  misc_feature: GYAE6OF01D8ZGH.49.65.F10.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcncatagn

SEQ ID NO: 173776 - DNA, 295 bp, Homo sapiens
  misc_feature: GYAE6OF01DLBF9.49.65.F10.1.454.CMB.1.raw
  modified_base (285)..(285): a, c, t, g, unknown or other
  misc_feature (285)..(285): n is a, c, g, or t
  modified_base (290)..(295): a, c, t, g, unknown or other
  misc_feature (290)..(295): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcgggctggcaaggcgnatagnnnnnn

SEQ ID NO: 173777 - DNA, 293 bp, Homo sapiens
  misc_feature: GYAE6OF01ECL41.49.65.F10.1.454.CMB.1.raw
  modified_base (107)..(107): a, c, t, g, unknown or other
  misc_feature (107)..(107): n is a, c, g, or t
  modified_base (263)..(266): a, c, t, g, unknown or other
  misc_feature (263)..(266): n is a, c, g, or t
  modified_base (268)..(270): a, c, t, g, unknown or other
  misc_feature (268)..(270): n is a, c, g, or t
  modified_base (272)..(293): a, c, t, g, unknown or other
  misc_feature (272)..(293): n is a, c, g, or t
tcagagtcgagagacacgaccggtgctcgatttagctacgctctaaggggacacggccaccctgaccatcagcagggtcgaagccggggatgaggccgactattacngtcacgtgtgggacagtagtagtgatcatgtggtgttcggcggagggaccaagctgaccgtctaggtcagcccaaggcctgcccccctggtcactctcgttccccacctcctctctctcgactctggagcgggtacctggacaagggcgcagtagnnnngnnnannnnnnnnnnnnnnnnnnnnnn

SEQ ID NO: 173778 - DNA, 296 bp, Homo sapiens
  misc_feature: GYAE6OF01CFSQH.49.65.F10.1.454.CMB.1.raw
  modified_base (262)..(262): a, c, t, g, unknown or other
  misc_feature (262)..(262): n is a, c, g, or t
  modified_base (267)..(296): a, c, t, g, unknown or other
  misc_feature (267)..(296): n is a, c, g, or t
tcagagtcgagagacacgaccggtgctcgatttagctacgctctaaggggacacggccacccctgaccagtcagcagggttcgaagccggggatgaggccgactattactgtcacgtggtgggacagtagtagtgatcatggtggtgttcggcggagggaccaagcttagaccgtcctaggtcagcccaaggctgcccccgtggtcactcgtgttccccacctcctcgtccgtctcgactctgacgccgggctggcaaggcncatgnnnnnnnnnnnnnnnnnnnnnnnnnnnnnn

SEQ ID NO: 173779 - DNA, 275 bp, Homo sapiens
  misc_feature: GYAE6OF01ECLPM.49.65.F10.1.454.CMB.1.raw
  modified_base (257)..(275): a, c, t, g, unknown or other
  misc_feature (257)..(275): n is a, c, g, or t
tcagagtcgagagacacgaccggtgctcgatttagctacgctctaagggacacgggccaccctgaccatcagcagggtcgaagccggggatgaggccgactattactgtcacgtgtgggacagtagtagtgatcatgtggtgttcggcggagggaccaagctgaccgtcctaggtcagcccaaggcctgcccccctggtcactctgttccccaccctcctctctctcgactctgagcgggctggcaaggcgcatagnnnnnnnnnnnnnnnnnnn

SEQ ID NO: 173780 - DNA, 818 bp, Homo sapiens
  misc_feature: GYAE6OF01CERH4.49.65.F10.1.454.CMB.1.raw
  modified_base (627)..(627): a, c, t, g, unknown or other
  misc_feature (627)..(627): n is a, c, g, or t
  modified_base (796)..(796): a, c, t, g, unknown or other
  misc_feature (796)..(796): n is a, c, g, or t
tcagagtcgagagacacgaccggtgctcgatttagctacgctctaaggggggagaggagcccagcactagaagtcggcggtgtttccattcggtgatcagcactgaacacagaggactcacatggagtttgggctgagcttgggttttcctcgttgctcttttaagaggtgtccagtgtcaggtgcagctggtggagtcgtgggggagcgtggtccagccgtggggacgtcctgacgactctcctgtagaacgtcctcgtggtacttccgaccttacaaaggtaaccttttggactaagtcggtaccgtacggttcggggtcccgaccgtacgggtcctaccccggaagggtcccgaacgggggtcctaggggtacggggttcggggttagggaccttaagggttacttccgtacgaaggtagttaggtaacgttaaagggtaaaaagtttaaaaaaggttccgttaacggtttaacccggtaacctttacccggttaagggaaaccggggtacccgttaagttacccctaaaccgtacgtttacccgtaacccgaaacggtaacgtaaacctaaaccgtttaaccgaaaacgtaaccgttaccgttaagacctaattaacctaaanaaacgtcgacctaacgtaacgtccgtaacggactaaccgtaggaaacggccgtaacgtcgtaggtagtacgtttacggagggtacggtacggggtaaagggggttacggttagtttagacgttaaccggtttccggaaacccttcggttaacggaaccgtttaccgggnggggtaaccccgtaaaccgggg

SEQ ID NO: 173781 - DNA, 272 bp, Homo sapiens
  misc_feature: GYAE6OF01DF1LD.49.65.F10.1.454.CMB.1.raw
  modified_base (254)..(254): a, c, t, g, unknown or other
  misc_feature (254)..(254): n is a, c, g, or t
  modified_base (259)..(272): a, c, t, g, unknown or other
  misc_feature (259)..(272): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgacttctggagccgggctaggcaaggcganatagnnnnnnnnnnnnnn

SEQ ID NO: 173782 - DNA, 238 bp, Homo sapiens
  misc_feature: GYAE6OF01EIUV1.49.65.F10.1.454.CMB.1.raw
tcagagtcgagagacacgaccggtgctcgatttagctacgctctaagggacacggccaccctgaccatcagcaggtcgaagccggggatgaggccgactattactgtcacgtgtgggacagtagtagtgatcatgtggtgttcggcggagggaccaagctgaccgtcctaggtcagcccaaggctgccccctggtcactctgttccccgccttcctctctctcgactcctgagcgggc

SEQ ID NO: 173783 - DNA, 273 bp, Homo sapiens
  misc_feature: GYAE6OF01C54HC.49.65.F10.1.454.CMB.1.raw
  modified_base (252)..(273): a, c, t, g, unknown or other
  misc_feature (252)..(273): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaatgctgccccctggtcactctgttctcgccctcctctctctcgactctgagcggctggcaaggcgcatagnnnnnnnnnnnnnnnnnnnnnn

SEQ ID NO: 173784 - DNA, 257 bp, Homo sapiens
  misc_feature: GYAE6OF01EYALM.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnn

SEQ ID NO: 173785 - DNA, 266 bp, Homo sapiens
  misc_feature: GYAE6OF01ENNDD.49.65.F10.1.454.CMB.1.raw
  modified_base (211)..(211): a, c, t, g, unknown or other
  misc_feature (211)..(211): n is a, c, g, or t
  modified_base (259)..(266): a, c, t, g, unknown or other
  misc_feature (259)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctccgcccgtcgtcactcttcgtcccncctcctctctctcgctcgtgcggcggtcgtggacgacggcgctagagnnnnnnnn

SEQ ID NO: 173786 - DNA, 254 bp, Homo sapiens
  misc_feature: GYAE6OF01B1UJ6.49.65.F10.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnn

SEQ ID NO: 173787 - DNA, 262 bp, Homo sapiens
  misc_feature: GYAE6OF01DY2MR.49.65.F10.1.454.CMB.1.raw
  modified_base (253)..(262): a, c, t, g, unknown or other
  misc_feature (253)..(262): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctggagcgggctggcaaggcgcatagnnnnnnnnnn

SEQ ID NO: 173788 - DNA, 257 bp, Homo sapiens
  misc_feature: GYAE6OF01D1H9Y.49.65.F10.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccacctcctctctctcgactctgagcggctggcaaggcgcatagnnnnnn

SEQ ID NO: 173789 - DNA, 259 bp, Homo sapiens
  misc_feature: GYAE6OF01AK8SA.49.65.F10.1.454.CMB.1.raw
  modified_base (237)..(237): a, c, t, g, unknown or other
  misc_feature (237)..(237): n is a, c, g, or t
  modified_base (253)..(259): a, c, t, g, unknown or other
  misc_feature (253)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcggntggcaaggcgcatagnnnnnnn

SEQ ID NO: 173790 - DNA, 562 bp, Homo sapiens
  misc_feature: GYAE6OF01DJKS9.49.65.F10.1.454.CMB.1.raw
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagagtcgagagacacgaccggtgctcgatttagctacgctctaagggacgacggccgaccctggaccatcaagcagggtcgaagccgggatcgaggccgtactatttacctgtctacgtgtgggacagtagtagtggatcaagtgtggtgttcggcgaggaccaagctgaccgtcctagtctagcccaagtctcgcccctggtcactctcgttcccacctctctcgtctacgacttcgtagtacgtcgggctggcaaggcagaatagtatcntcganacagacagcactcactatctntatcncatcnctncgcgccgtccgtccgactctcgagcgcgtcgtcgtcgcgacgtctctctctcacactacncgacactacgcnactacagacgagtagtagtagtgttatagtatatatatacttcgttacgttacgttacgttacgtacggtacggtacgtacggtacgtacggtacgtacgtaacgtaacgtacgtacgtacgtacgtacgtacgtacgtacgtacgtcgtcgtacgtacgtccgtactccgtcgtcg

SEQ ID NO: 173791 - DNA, 284 bp, Homo sapiens
  misc_feature: GYAE6OF01AQUA5.49.65.F10.1.454.CMB.1.raw
  modified_base (260)..(284): a, c, t, g, unknown or other
  misc_feature (260)..(284): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagcgtgaccgtcctaggtcagcccaaggctcgccccctcggtcactctcgttccccgccctcctctctctcgactctgagcgggctggcaaggcgcatagnnnnnnnnnnnnnnnnnnnnnnnnn

SEQ ID NO: 173792 - DNA, 257 bp, Homo sapiens
  misc_feature: GYAE6OF01AXHDE.49.65.F10.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcggctggcaaggcgcatagnnnnnn

SEQ ID NO: 173793 - DNA, 262 bp, Homo sapiens
  misc_feature: GYAE6OF01BY6IZ.49.65.F10.1.454.CMB.1.raw
  modified_base (255)..(262): a, c, t, g, unknown or other
  misc_feature (255)..(262): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnnnnnnnn

SEQ ID NO: 173794 - DNA, 632 bp, Homo sapiens
  misc_feature: GYAE6OF01A3KHG.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgaagcctctggattcacctttcaagaactttggcatgcactgggtcccgccaggctccgaggcacggggctgggagtggggtggcagttatctacgagatgagtaggaaagtaaaaagtactagttacggactccttagaagggcctatcaccgtatcctaccgagacgacaacttaccgaaagtaaccacttagactactactaacaaatcgacaactacgtcttagaacgtaccgtaggacggacgtacggtcttggtacgttattaccgttggtacggtacggggtaaagggggggtacgggttagttttcgggacttacggttcggtaccctaacgtttacgggtaccttacggtccgggggtacccggtaaacccgggg

SEQ ID NO: 173795 - DNA, 331 bp, Homo sapiens
  misc_feature: GYAE6OF01BBSD5.49.65.F10.1.454.CMB.1.raw
  modified_base (125)..(125): a, c, t, g, unknown or other
  misc_feature (125)..(125): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (270)..(271): a, c, t, g, unknown or other
  misc_feature (270)..(271): n is a, c, g, or t
  modified_base (273)..(331): a, c, t, g, unknown or other
  misc_feature (273)..(331): n is a, c, g, or t
tcagagtcgagagacacgaccggtgctcgatttagctacgctctaagggacacggccaacccgtgaccatcagcagggtcgaagccgggggatgaggccgacctattactgtcacgtgtgggacngtagtagtgatcatgtggtgttggcgagggaccaagctgacgtcctaggtcagccaaggctgccccctggtcnctctgtccccgcctcgtcnctcctcgactctggagcgggctggcaaggcgtcgagtacgnctncgtgacnanngnnnnnnnnnnnnnnnnnnnnnnnnnnnnnnnnnnnnnnnnnnnnnnnnnnnnnnnnnnn

SEQ ID NO: 173796 - DNA, 841 bp, Homo sapiens
  misc_feature: GYAE6OF01DM2Y7.49.65.F10.1.454.CMB.1.raw
  modified_base (190)..(190): a, c, t, g, unknown or other
  misc_feature (190)..(190): n is a, c, g, or t
tcagagtcgagagacacgaccggtgctcgatttagctacgctctaagggggggagaggagcccagcactagaagtcggcggtgttccattcggtgatcagcactgaacacagaggactcaccatggagtttgggctgagcgttgggttttcctcgttgcttacttttaaggaggtgtccagtgtcaggtncagcgtggtggagtcgtgggggaggcggtggtccaggccgtggggacggtccctgacgtacctctcctgtagaacgccttctaggtacttcaaccttacaagtaacttggcatgccacgtcggccgcctaggctccgagggccggacggggtcgtagggtcggtggggtcgacgttagttactccgtagaggtaataggaagtaagggtaaaaacgtaaaacgttacttacgttacggtacttacccggtaggaaaccggggtccttacgtacctaaaccgtacttacccgtaacgtaagaaccgtaactaacctttaaccgaaaaggttaaaccctacgttagtaacccttaacttaacctaaacgtaacgtacgaccgtaacgttacgttacgaacggtaaccgtaaccggaggtaacccggtaacgttaccgggtcctttaaggtacgtttaaccgttaaacggttcggggttaaggggaaacccgggggggtaaagggggggttaaacggggtttttaacgtttttcgggaaacccgttaaaacggggtttcccccgttaaaaccccgggttacttttaaacccgggggaaacccggtttaccgggggttacccggggggggtaaacccccttaaaaccccgggggg

SEQ ID NO: 173797 - DNA, 259 bp, Homo sapiens
  misc_feature: GYAE6OF01BE695.49.65.F10.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccacctcctctctctcgactctgagcggctggcaaggcgtcatagnnnnnnn

SEQ ID NO: 173798 - DNA, 257 bp, Homo sapiens
  misc_feature: GYAE6OF01DJD3Q.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccaccctcctctctctcgactctgagcggctggcaaggcgcatagnnn

SEQ ID NO: 173799 - DNA, 266 bp, Homo sapiens
  misc_feature: GYAE6OF01BH3JJ.49.65.F10.1.454.CMB.1.raw
  modified_base (256)..(266): a, c, t, g, unknown or other
  misc_feature (256)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagccgggctggcaaggcgcatagnnnnnnnnnnn

SEQ ID NO: 173800 - DNA, 860 bp, Homo sapiens
  misc_feature: GYAE6OF01CP0MZ.49.65.F10.1.454.CMB.1.raw
  modified_base (311)..(311): a, c, t, g, unknown or other
  misc_feature (311)..(311): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagctggtggagtcgtggggagcgtggtccagccgtgggacgtccctgacgctctccgtgtagacgccctgtggtacttccaccttacaagtaactttggctatcgccgtacgtcgggtcccnccgacggtcctccgaggccggaccggggtctgggtacggttggggtcggaccgttaaggtttactcgtacgaaggtagttaggaagttaagggaaaaagtttaaaaacgttaccgtttaagtttaccggtaacctttccgtttaaggggaaaccgggtaccgttaacgtttacccaaacccgtacgttacccgtaaccgtaacgtaaaccgtaaccgttaaacgttaaccccgaaaacgtaaacccgttaccgtttaacggtaccctaacttaacccgtaaaccgtaaacgtcgtaaccgtaacgtaacgttaccgtaacggtaaccgtaccgttaacgggaaccgggtaacccgtacgggttaccttaggttacgttaacgtttacggttcgggtacgggtaacgggggtaaaaggggggtttacggggtttacgttttttaacgggacccgtttaacggtttacccgggttaaccccgttaccgggtttaaccggtaacccgggtttaaccgggttacccgggggtacccgttaaaacccccggggg

SEQ ID NO: 173801 - DNA, 295 bp, Homo sapiens
  misc_feature: GYAE6OF01A96BV.49.65.F10.1.454.CMB.1.raw
  modified_base (291)..(295): a, c, t, g, unknown or other
  misc_feature (291)..(295): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttcccgccctcctctctctcgactctgagcgggctggcaaggcgcatagnnnnn

SEQ ID NO: 173802 - DNA, 257 bp, Homo sapiens
  misc_feature: GYAE6OF01BZCAO.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccgccctcctctctctcgactctgagcgggctggcaaggcgcatagnnn

SEQ ID NO: 173803 - DNA, 259 bp, Homo sapiens
  misc_feature: GYAE6OF01DM86M.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttcccaccctccttctctctcgactctgagcggctggcaggcgcatagnnnnn

SEQ ID NO: 173804 - DNA, 254 bp, Homo sapiens
  misc_feature: GYAE6OF01BU04M.49.65.F10.1.454.CMB.1.raw
  modified_base (254)..(254): a, c, t, g, unknown or other
  misc_feature (254)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagn

SEQ ID NO: 173805 - DNA, 265 bp, Homo sapiens
  misc_feature: GYAE6OF01D37HI.49.65.F10.1.454.CMB.1.raw
  modified_base (252)..(265): a, c, t, g, unknown or other
  misc_feature (252)..(265): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggaggaccaagctgaccgtctaggtcagcccaagctgccccctggtcactctcgttcccacctcctctctctcgactctgacgcggctggacacggcgacatagnnnnnnnnnnnnnn

SEQ ID NO: 173806 - DNA, 676 bp, Homo sapiens
  misc_feature: GYAE6OF01C69AU.49.65.F10.1.454.CMB.1.raw
  modified_base (189)..(189): a, c, t, g, unknown or other
  misc_feature (189)..(189): n is a, c, g, or t
  modified_base (470)..(470): a, c, t, g, unknown or other
  misc_feature (470)..(470): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
  modified_base (656)..(656): a, c, t, g, unknown or other
  misc_feature (656)..(656): n is a, c, g, or t
tcagagtcgagagacacgaccggtgctcgatttagctacgctctaagggggggagaggagcccagcactagaagtcggcggtgtttccattcggtgatcagcactgaacacagaggactcacatggagttgggctgagctgggttttcctcgttgccttctttaaggaggtcgtccagtgtcaggtgcngctgggtggagtcgtgggggaggtcgtggtccagccgtggggacggtccctggacgacctctcctgtagacgtcctctggacttactaccttagaaacgtaacgtttggacctatcggtaccaccgttcggggtcccgcccgtacggccctaccggacgggccggaccggggtcggtagggtagggttggggtcggtacgttaggttactcgacgagtagtagtagtaacggtaaaagttaaaagtacttaggtacgtactcgtaggacggtctactcacnctcacagagtaactactacaacgtactacgtnactatacaactaancacaacntacgtanaccgtacgaggaccgtacgacggtcgttcgtagttacttacggtggtacggggtaaggggtaaacgggggtaggtttactttaggacgttaccggtactacccgttagttacgacggttaccgggnggggtaaccccgtaaccggg

SEQ ID NO: 173807 - DNA, 261 bp, Homo sapiens
  misc_feature: GYAE6OF01BFBOQ.49.65.F10.1.454.CMB.1.raw
  modified_base (255)..(261): a, c, t, g, unknown or other
  misc_feature (255)..(261): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcgggctggcaaggcgcatagnnnnnnn

SEQ ID NO: 173808 - DNA, 261 bp, Homo sapiens
  misc_feature: GYAE6OF01BWZHV.49.65.F10.1.454.CMB.1.raw
  modified_base (256)..(261): a, c, t, g, unknown or other
  misc_feature (256)..(261): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcgggctggcaaggcgcatagnnnnnn

SEQ ID NO: 173809 - DNA, 258 bp, Homo sapiens
  misc_feature: GYAE6OF01B6M4P.49.65.F10.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnn

SEQ ID NO: 173810 - DNA, 259 bp, Homo sapiens
  misc_feature: GYAE6OF01EN9BE.49.65.F10.1.454.CMB.1.raw
  modified_base (255)..(259): a, c, t, g, unknown or other
  misc_feature (255)..(259): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccaccctcctctctctcgactctgagcgggctggcaaggcgcatagnnnnn

SEQ ID NO: 173811 - DNA, 264 bp, Homo sapiens
  misc_feature: GYAE6OF01E0ZHQ.49.65.F10.1.454.CMB.1.raw
  modified_base (258)..(264): a, c, t, g, unknown or other
  misc_feature (258)..(264): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccccctggtcactctcgttccccgccctcctctctctcgactctgagcgggctggcaaggcgcagtagnnnnnnn

SEQ ID NO: 173812 - DNA, 257 bp, Homo sapiens; identical to SEQ ID NO: 173511
  misc_feature: GYAE6OF01AHJNK.49.65.F10.1.454.CMB.1.raw
  modified_base (255)..(257): a, c, t, g, unknown or other
  misc_feature (255)..(257): n is a, c, g, or t

SEQ ID NO: 173813 - DNA, 261 bp, Homo sapiens
  misc_feature: GYAE6OF01AOPRV.49.65.F10.1.454.CMB.1.raw
  modified_base (234)..(234): a, c, t, g, unknown or other
  misc_feature (234)..(234): n is a, c, g, or t
  modified_base (254)..(261): a, c, t, g, unknown or other
  misc_feature (254)..(261): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccaccctcctctctctcgactctgngcggctggcaggcgcatagnnnnnnnn

SEQ ID NO: 173814 - DNA, 778 bp, Homo sapiens
  misc_feature: GYAE6OF01B7GLP.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacggtccctgagactctcctgtgaagcctctgtacttccaccttacgaaagtaaccgtttggcctagtcgacctacggtcggggtcccgccgaggtccctccgagggccgaccgggggctagggacgggtggggtcgacgtagttatctacgaggtactaggaacgtaagggtaaaaagttaaaaacgttccttaggttacccggtactttaccgttaaggggaacgggtacccttaacgtttacccaaccgttacttcccgttacccgaacggaaccgtaacctaaaccgtttaacccgaaaacgtaaaccctacccgtttagaccctaacgttaaccttaaaccgaaacttcgacctaacgtatccgtagacgtaacccgtggacggtaacgtacggttacgttaggttacgttaacgttcggttacgggtacgggtaaaccgggggtaagggggggtaccgggttttaagttttccggacgttaccggttaccggtaacccgttcgttacggaccgttaccgggtcgggggtacccgtaaacccgggg

SEQ ID NO: 173815 - DNA, 308 bp, Homo sapiens
  misc_feature: GYAE6OF01DKCZ1.49.65.F10.1.454.CMB.1.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (255)..(308): a, c, t, g, unknown or other
  misc_feature (255)..(308): n is a, c, g, or t
tcagagtcgagagacacgaccggtgctcgatttagctacgctctaaggggacacggccaccctgaccatcagcagggtcgaagccggggatggaggccgactattactgtcacgtgtgggacagtagtagtgatcatgtggtgttcggcggagggaccaagctgaccgtcctaaggtcagcccaaggctgccccctggtcactctgttcccacctcctctctntcgctctgngcggtntcggcaagggcatgatnnnnnnnnnnnnnnnnnnnnnnnnnnnnnnnnnnnnnnnnnnnnnnnnnnnnnn

SEQ ID NO: 173816 - DNA, 286 bp, Homo sapiens
  misc_feature: GYAE6OF01DSN9I.49.65.F10.1.454.CMB.1.raw
  modified_base (256)..(286): a, c, t, g, unknown or other
  misc_feature (256)..(286): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctggtaactctcgttccccacccgtcctctctctcgactctgacggcgggctggcaggcgcatagnnnnnnnnnnnnnnnnnnnnnnnnnnnnnnn

SEQ ID NO: 173817 - DNA, 257 bp, Homo sapiens
  misc_feature: GYAE6OF01BP7YF.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttccccgccctcctctctctcgactctgagcgggctggcaaggcgcatagnnn

SEQ ID NO: 173818 - DNA, 286 bp, Homo sapiens
  misc_feature: GYAE6OF01E2EPV.49.65.F10.1.454.CMB.1.raw
  modified_base (257)..(265): a, c, t, g, unknown or other
  misc_feature (257)..(265): n is a, c, g, or t
  modified_base (267)..(286): a, c, t, g, unknown or other
  misc_feature (267)..(286): n is a, c, g, or t
tcagagtcgagagacacgaccggtgctcgatttagctacgctctaaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctcgccccctggtcactctcgtccccacctcctctctctcgactctggacgcgggctcggacaaggcgcatgnnnnnnnnncnnnnnnnnnnnnnnnnnnnn

SEQ ID NO: 173819 - DNA, 263 bp, Homo sapiens
  misc_feature: GYAE6OF01B99CY.49.65.F10.1.454.CMB.1.raw
  modified_base (256)..(263): a, c, t, g, unknown or other
  misc_feature (256)..(263): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggccaaccccactgtcactctcgttcccgccctcctctctctcgactctgacgcgggctggcaaggcgcatagnnnnnnnn

SEQ ID NO: 173820 - DNA, 553 bp, Homo sapiens
  misc_feature: GYAE6OF01B4A1P.49.65.F10.1.454.CMB.1.raw
  modified_base (256)..(256): a, c, t, g, unknown or other
  misc_feature (256)..(256): n is a, c, g, or t
  modified_base (341)..(341): a, c, t, g, unknown or other
  misc_feature (341)..(341): n is a, c, g, or t
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
tcagagtcgagagacacgaccggtgctcgatttagctacgctctaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgaagcctntggattcaccttcaagaactttggcatgcacgtggggtccgccaaggctccgaggcacggggctgggagtgggtgcagttatctnagatgataggaaagtaaaaagtataatcggactcttagaacgggcgaattcacatctccagagacaattcaaagaactacttgacaatctaacaaatgacacaagtccaggacacctgagacagctgtntattactgtgacggaaggggggnggtagttttggcagttacggacccctagttcgaacgtacggtggggtcccgaaaccgggg

SEQ ID NO: 173821 - DNA, 270 bp, Homo sapiens
  misc_feature: GYAE6OF01ADSSY.49.65.F10.1.454.CMB.1.raw
  modified_base (132)..(132): a, c, t, g, unknown or other
  misc_feature (132)..(132): n is a, c, g, or t
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (253)..(254): a, c, t, g, unknown or other
  misc_feature (253)..(254): n is a, c, g, or t
  modified_base (256)..(257): a, c, t, g, unknown or other
  misc_feature (256)..(257): n is a, c, g, or t
  modified_base (259)..(270): a, c, t, g, unknown or other
  misc_feature (259)..(270): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatnatgtggtgttcggcggaggaccaagctgaccgtccgtagtcagcccaaggctcnccccctggtcactctcgttccccaccctctctctcncacctntggcgnggctggcaaggcncaatgnncnntnnnnnnnnnnnn

SEQ ID NO: 173822 - DNA, 263 bp, Homo sapiens
  misc_feature: GYAE6OF01CNPYV.49.65.F10.1.454.CMB.1.raw
  modified_base (256)..(263): a, c, t, g, unknown or other
  misc_feature (256)..(263): n is a, c, g, or t
tcagagtcgagagacacgaccggtgctcgatttagctacgctctaaggggacacggccaccctgaccatcagcagggtcgaagccggggatgaggccgactattactgtcacgtgtggacagtagtagtgatcatggtggtgttcggcggagggaccaagctgaccgtcaggtcagccaaggctcgcccctggtcactctcgttccccaccctctctctcctcgactctgaggcgggctggcaaggcgtacagtgnnnnnnnn

SEQ ID NO: 173823 - DNA, 552 bp, Homo sapiens
  misc_feature: GYAE6OF01APL3A.49.65.F10.1.454.CMB.1.raw
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagagtcgagagacacgaccggtgctcgatttagctacgctctaagggggggagaggagcccagcactagaagtcggtggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcaggttatctcagatgatggaaataaaagtctatcggactctgagggcatcacntctcananacatccaanacactncatcacaatgacacagtctgacgacctaggacggacacggtctgtcgtattacgtggtggacgggtaagggggtgggttagttttaggcgttaaggttccggaacccgtacgttacggaaccttacgggtcgggggccgtaaacccgggg

SEQ ID NO: 173824 - DNA, 619 bp, Homo sapiens
  misc_feature: GYAE6OF01BGG7M.49.65.F10.1.454.CMB.1.raw
  modified_base (255)..(255): a, c, t, g, unknown or other
  misc_feature (255)..(255): n is a, c, g, or t
  modified_base (334)..(334): a, c, t, g, unknown or other
  misc_feature (334)..(334): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctcnggattcaccttcaagaactttggcatgcactgggtccgccaggctccgaggcacggggctggaggtgggtggcagttanctcagtatgagtaggaagtaaaagtctagttcggacttccgtaggaacgggccgtattcacctatctccagagacaattccaagaacaccttagcaactctaacaaatcgacactagtcctagaacgacctaggaacggaccacggtcctggttagttaacgttaccgtggttacggacgggtaagggggggtaaggggttagtttttacgggcgttaaggttaccgggaacccgttacggtttaggtaaccgttaaccggtcgggggtcccgtaaacccggggg

SEQ ID NO: 173825 - DNA, 310 bp, Homo sapiens
  misc_feature: GYAE6OF01EJJ98.49.65.F10.1.454.CMB.1.raw
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (289)..(310): a, c, t, g, unknown or other
  misc_feature (289)..(310): n is a, c, g, or t
tcagagtcgagagacacgaccggtgctcgatttagctacgctctaagggcacgaccggtgctcgatttagctacgctctagggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcctgccccctggtcacctcngttccccccctcctctctctcgactcngagcggctggcaaggcncatgnnnnnnnnnnnnnnnnnnnnnn

SEQ ID NO: 173826 - DNA, 260 bp, Homo sapiens
  misc_feature: GYAE6OF01CFHZY.49.65.F10.1.454.CMB.1.raw
  modified_base (256)..(260): a, c, t, g, unknown or other
  misc_feature (256)..(260): n is a, c, g, or t
tcagagtcgagagacacgaccggtgctcgatttagctacgctctaaggggacacggccaccctgaccatcagcagggtcgaagccggggatgaggccgactattactgtcacgtgtggacagtagtagtgatcatgtggtgttcggcggagggaccaagctgaccgtcctaggtcagcccaaggctcgccccctcggtcactctgttccccaccctcctctctctcgactctgagcgggctggcaaggcgcatagnnnnn

SEQ ID NO: 173827 - DNA, 280 bp, Homo sapiens
  misc_feature: GYAE6OF01C7FBX.49.65.F10.1.454.CMB.1.raw
  modified_base (265)..(280): a, c, t, g, unknown or other
  misc_feature (265)..(280): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcctcgccccctggtcactcctcgttccccaccctcctctctctcgactctgacggccggcgtcggacgacggcgcatagnnnnnnnnnnnnnnnn

SEQ ID NO: 173828 - DNA, 292 bp, Homo sapiens
  misc_feature: GYAE6OF01BEP4H.49.65.F10.1.454.CMB.1.raw
  modified_base (260)..(292): a, c, t, g, unknown or other
  misc_feature (260)..(292): n is a, c, g, or t
tcagagtcgagagacacgaccggtgctcgatttagctacgctctaagggacacgccaccctgaccatcagcagggtcgaagccggggatgaggccgactattactgtcaacgtgtgggacagtagtagtgatcatgtggtgttcggcggagggaccaagctgaccgtcctaggtcagcccaaggctcgccccctggtcactctcgttcccgccctccgtctactcgtcgacctctgacgcggctggacaaggcgcatagnnnnnnnnnnnnnnnnnnnnnnnnnnnnnnnnn

SEQ ID NO: 173829 - DNA, 809 bp, Homo sapiens
  misc_feature: GYAE6OF01BSL8J.49.65.F10.1.454.CMB.1.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagctggtttcctcgttgctctttaagaggtgtcaagtgtcaggtgcagctggtggagtcgtggggaggcgtggtccagccgtggggacgtccctgagactctccgtgtgaacgtcctctggacttcaccttcaagtaacctttggacatgcactgggtcccnccgaggcctaccgaggcgacggggtctgggacggtggggtacggctaggtttactcgtacgaagtntcggaagtagggtaaaagttaaaacgttacgttagttaccggtaaccttaccgttaggaaacgggggtcctaacttaccgaacccgttattacccgtacccgaaggaacgtaaccgtaaactttaccccgaaaacgtaaacccgttacccgttaacggtaccctactaccggtaaactaaacgttacggaccaaacgtacgttacgtacggtaccggaacccgttggaaaccgggtaaccgaccgggtacgttacggttacggttaacgttaacggttcgggtacggggtaaccggggttaaaaggggggggtacgggttttaaggtttttccgggaaaccgtttacgggtttaaccccgggttaaaccccgtacccggtttttaacgggtaaccccggttaaccggggttcccggggggtaacccccgggttaaacccggggg

SEQ ID NO: 173830 - DNA, 261 bp, Homo sapiens
  misc_feature: GYAE6OF01A0XLV.49.65.F10.1.454.CMB.1.raw
  modified_base (255)..(261): a, c, t, g, unknown or other
  misc_feature (255)..(261): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctgttccccaccctcctctctctcgactctgagcggctggcaaggcgcatagnnnnnnn

SEQ ID NO: 173831 - DNA, 264 bp, Homo sapiens
  misc_feature: GYAE6OF01BIIFQ.49.65.F10.1.454.CMB.1.raw
  modified_base (255)..(264): a, c, t, g, unknown or other
  misc_feature (255)..(264): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccctcctctctctcgactctgagcgggctggcaaggcgcatagnnnnnnnnnn

SEQ ID NO: 173832 - DNA, 664 bp, Homo sapiens
  misc_feature: GYAE6OF01A9XW3.49.65.F10.1.454.CMB.1.raw
  modified_base (526)..(526): a, c, t, g, unknown or other
  misc_feature (526)..(526): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (577)..(577): a, c, t, g, unknown or other
  misc_feature (577)..(577): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagtcttgggttttccctcgttgcttcgttttaagaggtgtccagtgtcaggtgcagctggtggagtcggtggggagcgtggtccagccgtgggacgtccctgacgcttctcctgtagacgtcctgtggtacttccgtaccttacaaagttaaccgtttggactagtacgaccgtaccggttcggggtacccccgaccgtacgggtccctacccggaacgggtcccggaccgggggtcgtaggggtaggttcggggtacggtacgtaggtttacgtcgtacgaagtgtaggaagtaaggtaaaacgttaaaagtcgtagttaccgactcgtaggacggtctattaccactatccgtacaagacgaactaactacgaagtactacgttanactagtactaanaancgactagtcgtacagacgacctagacgtcgacggtntcgtagtacgtcgtgtagggaacgggtagggtggtttacttaggcgtcgtaccgtacgtgttacgacgtacggtgggacccgtacgg

SEQ ID NO: 173833 - DNA, 787 bp, Homo sapiens
  misc_feature: GYAE6OF01A61DS.49.65.F10.1.454.CMB.1.raw
  modified_base (327)..(327): a, c, t, g, unknown or other
  misc_feature (327)..(327): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagcgttgggttttcctcgttgcttcgttttaagaggttcgtccagtcgttcaggtgcagctggtggagtcgtggggagcgtggccagccgtgggacgtccctgagtctcgtctgtagaacgcctcgtggtacttcacctttacaaaggtaaccgtttggactagtcgtccgaacgttcgggggtaccccncgacggtcctccgaagggtccgacggggtctgggaggttgggtacggacctaggtttactcgttacgaagtaggtactaaggttaggtaaaaaggtttaaaaacgtcggtttaacggtttcggtaacccgtttacggtttaacggggaaaccgggtcccgttaatttacccgaacctaagtttccccgaacgaacggtacgtaaacctaaaccgttttaccgaaacgtaaaccgtaccgttaccgaacgttaacgttaaccttaaaccgtaaagttaccggactaaaccgtacgtacctaacggtaacgaacccgttaggaaccggttacccgaaggtccgtacgttacgtaacgttgttacgggacgggtaacgggtaaggggggtacggtttaggtttacgaacgttacgttacggaaccgttcgttagaccgttacgggtcggtccggtaaaccggg

SEQ ID NO: 173834 - DNA, 258 bp, Homo sapiens
  misc_feature: GYAE6OF01EG9UU.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccaccctcctctctctcgactctgagcggctggcaaggcgcatagnnnnn

SEQ ID NO: 173835 - DNA, 294 bp, Homo sapiens
  misc_feature: GYAE6OF01DUEZ4.49.65.F10.1.454.CMB.1.raw
  modified_base (287)..(294): a, c, t, g, unknown or other
  misc_feature (287)..(294): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccctcggtcactctcgtcccaccctcctctctctcgactctgagcgggctgcaggcgcatagnnnnnnnn

SEQ ID NO: 173836 - DNA, 648 bp, Homo sapiens
  misc_feature: GYAE6OF01BCD9E.49.65.F10.1.454.CMB.1.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
tcagagtcgagagacacgaccggtgctcgatttagctacgctctaaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggaggcgtggtccagccgtggggaggtccctgacgactcgtcctggtgaacgcctgtggattcgaccttcgaagtacttggcagtgcacgtcgggtccncgaggctccgaggcgacggggtcngggtaggtgggtgtactagtttanactctaagtagtgaagtggaaagacaaaggtactaagtacgtagtacgtaacgtaccgttccggtaggtaacggtcctagtacagtcaacgtccacgtaagacgaactaaccgtaccgaacaaccgtacgtcgttatacgtaccgtagaaccaaagtcgaaaccgtggaccgttacggaagagtccgaagaaacgtacgtacggttactttaagtagttaccggtagtaccgtaacttaacgtttaacgcgaacgggtaaccgaacgtaaacccggtcccggaacccccgtccgg

SEQ ID NO: 173837 - DNA, 292 bp, Homo sapiens
  misc_feature: GYAE6OF01C9ED7.49.65.F10.1.454.CMB.1.raw
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (257)..(268): a, c, t, g, unknown or other
  misc_feature (257)..(268): n is a, c, g, or t
  modified_base (270)..(292): a, c, t, g, unknown or other
  misc_feature (270)..(292): n is a, c, g, or t
tcagagtcgagagacacgaccggtgctcgatttagctacgctctaagggacacggccaccctggaccatcagcagggtcgaagccggggatgaggccgactattactgtcacgtgtgggacagtagtagtgatcatgtggtgttcggcggagggaccaagctcgaccgtcctaggtcagcccaaggctcgccccctggtcactctcgttcccaccctctctctcncgactcgtgacgcggctggcaaggccnatagnnnnnnnnnnnngnnnnnnnnnnnnnnnnnnnnnnn

SEQ ID NO: 173838 - DNA, 292 bp, Homo sapiens
  misc_feature: GYAE6OF01DAZIY.49.65.F10.1.454.CMB.1.raw
  modified_base (256)..(256): a, c, t, g, unknown or other
  misc_feature (256)..(256): n is a, c, g, or t
  modified_base (261)..(292): a, c, t, g, unknown or other
  misc_feature (261)..(292): n is a, c, g, or t
tcagagtcgagagacacgaccggtgctcgatttagctacgctctaagggtacgacggccaccctgaccatcagcagggtcgaagccggggatgaggccgacgtattactgtcacgtgtgggacagtagtagtgagtcatggtggtggttcggcggagggaccaagctgaccgtcctaggtcagcccaaggctgccccctggtcactctgttccccaccctcctctctctcgactctgagcgggctggcaaggtcgnatagnnnnnnnnnnnnnnnnnnnnnnnnnnnnnnnn

SEQ ID NO: 173839 - DNA, 267 bp, Homo sapiens
  misc_feature: GYAE6OF01BNM1Y.49.65.F10.1.454.CMB.1.raw
  modified_base (251)..(251): a, c, t, g, unknown or other
  misc_feature (251)..(251): n is a, c, g, or t
  modified_base (257)..(267): a, c, t, g, unknown or other
  misc_feature (257)..(267): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtctaggtcagcccaaggctcgccccctggtcactctgttccccaccctcctctcctctcgactctgagcgggctggacaaggcncatagnnnnnnnnnnn

SEQ ID NO: 173840 - DNA, 296 bp, Homo sapiens
  misc_feature: GYAE6OF01EOCZP.49.65.F10.1.454.CMB.1.raw
  modified_base (291)..(296): a, c, t, g, unknown or other
  misc_feature (291)..(296): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccgccctcctctctctcgactctgacgcgggctggcaaggcgcatagnnnnnn

SEQ ID NO: 173841 - DNA, 987 bp, Homo sapiens
  misc_feature: GYAE6OF01DFYCE.49.65.F10.1.454.CMB.1.raw
  modified_base (226)..(226): a, c, t, g, unknown or other
  misc_feature (226)..(226): n is a, c, g, or t
tcagagtcgagagacacgaccggtgctcgatttagctacgctctaagggggggagaggagcccagcactagaagtcggcggtgtttccattcggtgatcagcactgaacacaggagactcaccagtggtagttgggctgagtcgttcgggtttttcctcggttgtcctttacgttttaaaggagggttgtcccgtaggttgttacgaggtgcagtcgtgggtaggnggtcgggtggggggaggtcggtcggtccgacggtccggtcggggtaccggttccgtagaccgtcctccgttccgtaggtacgtaaccgtccgttacgtcggtaccttacctaaccgttaacgtaaacggttaacgtttcgactacgtcgtaccgtaccggttccgggacccgaccggtacggtcccgaccgggaacgggtccgggtacgggggtcggtacggggtggggttcgggggtacgtacgtttaacggtttacctacggtacggtaaggtaaggttaagtaaagggttaaaaggtaaaaaacggtttaaaaacgttcgtttaaccgttaccggttaccgttaaccgggttaacgggaaccgggttacctaaccgttaaccctaccgtaccgttaccgaaaccgtaacgaaaccgttaaccttaaaccgtaaaccgaaacccgttaacccgttaaccgttacgaaccctttaaccttaagtaaaaaccgtaacgtaccgtaacgttaacgtaccgttacgtaagggtaacccgtacgtaaccgggaaccggtacccgttaacgggttcgtttaaggtttacgttaacggttacgggtaacggggacgggggttaaacgggggtttaagggggggttacttttaccgttttagggaaacccggtttaaaccgggttacccggttaacccgttaacggtttacccgggtaacccgggttaaacccgggccgggggttaaaccccgggttaaccccgggg

SEQ ID NO: 173842 - DNA, 263 bp, Homo sapiens
  misc_feature: GYAE6OF01BGH2A.49.65.F10.1.454.CMB.1.raw
  modified_base (255)..(263): a, c, t, g, unknown or other
  misc_feature (255)..(263): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatggtggtgttcggcggagggaccaagctgaccgtcctaggtcagcccaaggctgccccctggtcactctgttcccaccctcctctctctcgactctgagcgggctggcaaggcgcatagnnnnnnnnn

SEQ ID NO: 173843 - DNA, 262 bp, Homo sapiens
  misc_feature: GYAE6OF01BIRGP.49.65.F10.1.454.CMB.1.raw
  modified_base (256)..(262): a, c, t, g, unknown or other
  misc_feature (256)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttccccgccctcctctctctcgactctgagcgggctggcaaggcgcatagnnnnnnn

SEQ ID NO: 173844 - DNA, 290 bp, Homo sapiens
  misc_feature: GYAE6OF01ANYPK.49.65.F10.1.454.CMB.1.raw
  modified_base (258)..(290): a, c, t, g, unknown or other
  misc_feature (258)..(290): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttcccaccctctctctctcgactcgtgacggcgggctggcaaggcgcatagnnnnnnnnnnnnnnnnnnnnnnnnnnnnnnnnn

SEQ ID NO: 173845 - DNA, 835 bp, Homo sapiens
  misc_feature: GYAE6OF01BLIVX.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggccgtggggacggtccctggacgtacctcctccgtggtagaacgtcccttacgtgggtactttcccaaccgtttacgaaacggttaaccgttttgggacctaagttcggcctaacggttccgggggtccccgaccgacgggtccctccgagggccgacgggggctggggtaggtggggtacggcgtaggtttactccgtagaagtagttaggaagttagggaaaaagttaaaaacgtcgttacgttaccggtaacttacccgttagggaaacgggtcctaaattacccgaacctacttacccgtaccgaaggtaacggtaacctaacgtttaacccgaaaagtaaacccttacccgtttacggaacctaacttaccgttaaaacgaaacttcggaacctaacgacgtttaccgaacgaacgtaacccgttagggaaacggacccgtaacgggtccttaggttaacgttacgtttaccgtgggtaaccgggtagggggtaaaggggggttcgggtttaattttacgggaccgttaacggttaccccgggaaccccgttaagtttacgggtaacccggttaaccgggtccgggggtaaaccccgttaacccggggg

SEQ ID NO: 173846 - DNA, 314 bp, Homo sapiens
  misc_feature: GYAE6OF01E5GC6.49.65.F10.1.454.CMB.1.raw
  modified_base (292)..(292): a, c, t, g, unknown or other
  misc_feature (292)..(292): n is a, c, g, or t
  modified_base (298)..(314): a, c, t, g, unknown or other
  misc_feature (298)..(314): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttccccgccctcctctcctctcgtactctggagcggggcttggcaagggcncatagnnnnnnnnnnnnnnnnn

SEQ ID NO: 173847 - DNA, 267 bp, Homo sapiens
  misc_feature: GYAE6OF01DED9J.49.65.F10.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (252)..(267): a, c, t, g, unknown or other
  misc_feature (252)..(267): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggaggaccaagctgaccgtcctaggtcagcccaaggctcgccccctggtcactctcgttccccacctcctctctctcgactcngagcggctggcaaggcncatagnnnnnnnnnnnnnnnn

SEQ ID NO: 173848 - DNA, 653 bp, Homo sapiens
  misc_feature: GYAE6OF01A9ZB2.49.65.F10.1.454.CMB.1.raw
  modified_base (527)..(527): a, c, t, g, unknown or other
  misc_feature (527)..(527): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagcctggggacgtccctgagactctcctgtgacgcctctggtacttcaccttacaagtaacttggcatgcacgtcgggtcccgccgacggcctccgaggccggacggggcgtgggaggtgggtggacgtagtttatctcgagtagtagagtaaggaaaagttaaaagtactagttcggtactccgtaggaacggctatccactactcctaccgagaacgactaattaccaaacgaacctaccttagacctatactaaacaaagtcgactactacgtctagacgacctaggaccggtacgtacggtnttaggtacgttagttaccgtgggacggtaacgggggtaggggggtacggtttagttttcggacgttacgttaccggacccttacgtacgtaccggttacgggtaccggggtacccgtaacccgggg

SEQ ID NO: 173849 - DNA, 275 bp, Homo sapiens
  misc_feature: GYAE6OF01COGQB.49.65.F10.1.454.CMB.1.raw
  modified_base (257)..(275): a, c, t, g, unknown or other
  misc_feature (257)..(275): n is a, c, g, or t
tcagagtcgagagacacgaccggtgctcgatttagctacgctctaaggggacacggccaccctgaccatcagcagggtcgaagccggggatgaggccgactattactgtcacgtgtggacagtagtagtgatcatgtggtgttcggcggagggaccaagctgaccgtcctaggtcagcccaaggctcgcccccctggtccactctcgttccccaccctcctctctctcgactctgagcggctgcaaggcgcagtagnnnnnnnnnnnnnnnnnnn

SEQ ID NO: 173850 - DNA, 265 bp, Homo sapiens
  misc_feature: GYAE6OF01B7CLY.49.65.F10.1.454.CMB.1.raw
  modified_base (234)..(234): a, c, t, g, unknown or other
  misc_feature (234)..(234): n is a, c, g, or t
  modified_base (256)..(265): a, c, t, g, unknown or other
  misc_feature (256)..(265): n is a, c, g, or t
tcagagtcgagagacacgaccggtgctcgatttagctacgctctaagggacacggccaccctgaccatcagcagggtcgaagccggggatgaggccgactattactgtcacgtgtggacagtagtagtgatcatgtggtgttcggcggagggaccaagctgaccgtcctaggtcagcccaaggctcgccccctcggtcactctcgttccccaccctcctctctctcgactctgngcgggctggcaaggcgcatagnnnnnnnnnn

SEQ ID NO: 173851 - DNA, 287 bp, Homo sapiens
  misc_feature: GYAE6OF01CBF4J.49.65.F10.1.454.CMB.1.raw
  modified_base (253)..(287): a, c, t, g, unknown or other
  misc_feature (253)..(287): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggaggaccaagctgaccgtcctaggtcagccaaggctcgcccctcggtcactctcgttcccaccctcctctctctcgactctgacgcggctggacaggcgcgatgnnnnnnnnnnnnnnnnnnnnnnnnnnnnnnnnnnn

SEQ ID NO: 173852 - DNA, 686 bp, Homo sapiens
  misc_feature: GYAE6OF01ACYPC.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggtttttcctcgttgcttcttttaagaggtgtccagtgtcaggtgcagctggtggagtcgtgggggagcgtggtccagccgtggggacgtccctgagactctccgtgtgagcctgtggtacttccaccttcaagtaactttggctatgctacgtcgggtcccgccaggcctccgaggccgacggggtctgggagtgggtgctagttatcgcagatgagtaggaaataaaagtctagtcggactcgtaggacggtcctattccactatcctacgagactactaacttaccgaaacgtaacctaccttagacctacgtacctaactaaacgtcgaacctacgtacgttaccgaggtaaccgtaaccgtacgggaacgggtacccgtacgggttacttagggttacgttaacgtttacggtgggtacgggtaacgggggtaagggggggttacgggtttagttttacgggacgtttacggtacccggtacccgttaacggttacggtaaccggttacgggtccggggtaacccgtaaacccggggg

SEQ ID NO: 173853 - DNA, 303 bp, Homo sapiens
  misc_feature: GYAE6OF01B34DM.49.65.F10.1.454.CMB.1.raw
  modified_base (287)..(287): a, c, t, g, unknown or other
  misc_feature (287)..(287): n is a, c, g, or t
  modified_base (293)..(303): a, c, t, g, unknown or other
  misc_feature (293)..(303): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggcctcgccccctcggtcactctcgttcccaccctcctctctctcgactctgacgcgggctggcaaggcncatagnnnnnnnnnnn

SEQ ID NO: 173854 - DNA, 274 bp, Homo sapiens
  misc_feature: GYAE6OF01BWABX.49.65.F10.1.454.CMB.1.raw
  modified_base (259)..(274): a, c, t, g, unknown or other
  misc_feature (259)..(274): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtggttcggcggagggaccaagctgaccgtcctaggtcagcccaaggctcgcccctcggtcactctcttccccaccctcctctctctcgactctgacggcggctcggacaaggcgcatagnnnnnnnnnnnnnnnn

SEQ ID NO: 173855 - DNA, 262 bp, Homo sapiens
  misc_feature: GYAE6OF01E1YXE.49.65.F10.1.454.CMB.1.raw
  modified_base (253)..(262): a, c, t, g, unknown or other
  misc_feature (253)..(262): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctgccccctcggtcactctgttcccaccctcctctctctcgactctgagcgggctggcaaggcgcatagnnnnnnnnnn

SEQ ID NO: 173856 - DNA, 757 bp, Homo sapiens
  misc_feature: GYAE6OF01BNPA7.49.65.F10.1.454.CMB.1.raw
tcagagtcgagagacacgaccggtgctcgatttagctacgctctaaggggggtaggaggagcccagcactaggaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagtcgtggtccagccgtgggacgtccctgacgtactctcctgtgaacgcctctggtacttccaaccttcaaacgtaactttggctatgctacgtcggtccgccacggctaccggaggccgacggggcgtagggaggttggggtcggacgtagttactcgtacgaggtcgtaggtaagtagggtaaaagttaaaaacgtcgttaacgttaccggtaaccttccgtagggaaaccgggtccttaacgttacccaaccttaacgtcccgtaccgaaggtaacgtaaccttaacgttaccgaaacggtaaaccctaccgttacgaccctaattaacctaacgtaaaacgttcgaaccgtaacgtagttaccgtaggaaccgtaccgtagggaaccggtaaccgtacggtacgttagttacgttaacgttacggttcggtacggggtacggggttaaaggggggttggtttacttttcgggaccgttacggttacccggtaccgttaacggttacgtacccggttaacgggtccgggtaccgtaacccgggg

SEQ ID NO: 173857 - DNA, 311 bp, Homo sapiens
  misc_feature: GYAE6OF01BI1GH.49.65.F10.1.454.CMB.1.raw
  modified_base (257)..(257): a, c, t, g, unknown or other
  misc_feature (257)..(257): n is a, c, g, or t
  modified_base (286)..(311): a, c, t, g, unknown or other
  misc_feature (286)..(311): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtgtagtgatcatgtggtgtcggcggaggaccagctgacctcctaggtcacgccaaggctccgcccctgtcactctcgtcccacctctctctctcgactcnggacgccggctaggcaaggcactatagcnnnnnnnnnnnnnnnnnnnnnnnnnn

SEQ ID NO: 173858 - DNA, 260 bp, Homo sapiens; identical to SEQ ID NO: 173691
  misc_feature: GYAE6OF01A73PX.49.65.F10.1.454.CMB.1.raw
  modified_base (254)..(260): a, c, t, g, unknown or other
  misc_feature (254)..(260): n is a, c, g, or t

SEQ ID NO: 173859 - DNA, 279 bp, Homo sapiens
  misc_feature: GYAE6OF01BTSGT.49.65.F10.1.454.CMB.1.raw
  modified_base (250)..(250): a, c, t, g, unknown or other
  misc_feature (250)..(250): n is a, c, g, or t
  modified_base (255)..(279): a, c, t, g, unknown or other
  misc_feature (255)..(279): n is a, c, g, or t
tcagagtcgagagacacgaccggtgctcgatttagctacgctctaagggacacggccaccctgaccatcagcagggtcgaagccgggggatgaggccgactattactgtcacgtgtgggacagtagtagtgatcatgtggtgttcggcggagggaccaagctgaccgtcctaggtcagcccaaggctcgccccctggtcactctgttccccgcctcctctctctcgactctgagcgggctggcaaggcanatagnnnnnnnnnnnnnnnnnnnnnnnnn

SEQ ID NO: 173860 - DNA, 288 bp, Homo sapiens
  misc_feature: GYAE6OF01AQ0DT.49.65.F10.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (258)..(288): a, c, t, g, unknown or other
  misc_feature (258)..(288): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatggtggtgttcggcggagggaccaagctgaccgtcctaggtcacgcccaaggctcgccccctcggtcactctcgttccccacctcctctctcncgactngagcggctggacaggcgacatagnnnnnnnnnnnnnnnnnnnnnnnnnnnnnnn

SEQ ID NO: 173861 - DNA, 769 bp, Homo sapiens
  misc_feature: GYAE6OF01CW8C2.49.65.F10.1.454.CMB.1.raw
  modified_base (346)..(346): a, c, t, g, unknown or other
  misc_feature (346)..(346): n is a, c, g, or t
tcagagtcgagagacacgaccggtgctcgatttagctacgctctaagggggggagaggagcccagcactagaagtcggcggtgtttccattcggtgatcagcactgaacacagagactcaccatggagttgggctgagctgggttttcctcgttgcttctttaaggaggtgtccagtgtcaggtgcaggctgggtggagtcgtgggggaggcgtggtccaggccgtgggggacgtcccgtagaacgtactctccgtggtcgtaacgcctcgtaggactttaccaccctttacgaaacgtaaactttttgggacctaagttcggacctaccggttcgggggtccccncccgaagggtcctaccggaggccggaacgggggtccgtgggggagggttcggggttgggaccttaagggtttaactcctacgtaaggagttagtaaggttaaaggggtaaaaagtttaaaaaacggtacctttaaagtttacccgggtaacgttcccgtttaaggggaacgggtcccgtaacttccgaacctactccgtaccaagacgaactaactaaccaaacgaaacctactacgtctaactactaactaaagcaacgactatacgttagaacgactggaacggtaccgacgggtcgttgtacgttagttaacgtcgggtaggtacgggaaggggggtacgggttagttttcggaagttacggttacggacccttacggttacgtaaccgttaccggtggggtaacccggtaaacccgggg

SEQ ID NO: 173862 - DNA, 263 bp, Homo sapiens
  misc_feature: GYAE6OF01A5J10.49.65.F10.1.454.CMB.1.raw
  modified_base (254)..(263): a, c, t, g, unknown or other
  misc_feature (254)..(263): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctcgccccctcggtcactctgttccccaccctcctctctctcgactctgagcggctggcaaggcgcatagnnnnnnnnnn

SEQ ID NO: 173863 - DNA, 263 bp, Homo sapiens
  misc_feature: GYAE6OF01EV5R8.49.65.F10.1.454.CMB.1.raw
  modified_base (258)..(263): a, c, t, g, unknown or other
  misc_feature (258)..(263): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtctaggtcagcccaaggctcgccccctggtcactctcgttccccgcctcctctctctcgactcgtggagcgggctggacgaaggcgcatagnnnnnn

SEQ ID NO: 173864 - DNA, 921 bp, Homo sapiens
  misc_feature: GYAE6OF01ER8E7.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcctggggacggtccctgacgactctcctgtcgaagccttcgtggtactttccaaccctttacgaaagttaaccgttttggcctaagttcggcctacggttccggggtcccgaccgagggcctccggagggccggaccggggggctggggaggttgggggtcggactaaggtttactccgttacgaaggtagttaggtaaagttaaggggtaaaaaagttaaaaaacggttaccgttaaacggttttcccggggtaacctttacccggtttaaggggaaaccgggggtccccttaaacgtttaccccaaacccgtaacgtttacccttaaccccggaaaggtaaaccgtaaacctaaaccgtttaaccccgaaaaacggtaaaccctaacccgtttacgaaccctaaactttaacccttaaacctaaaacgtcgaccctaaccgtacggttacgtacggaaccgtaacccggttagggaaccgggtaacccgtaaccgggtcgtttacgggttaacgtttaacgtttaaccgggttgggttaacggggaaccggggggttaaagggggggggttacggggttttaagttttttaccgggaccgtttaacgggtttacccgggtaaaccccctttacgggtttaacggtaaaccccggtttaccggggttccgggggggtaaccccgtaaacccgggggg

SEQ ID NO: 173865 - DNA, 304 bp, Homo sapiens
  misc_feature: GYAE6OF01CDOCV.49.65.F10.1.454.CMB.1.raw
  modified_base (257)..(257): a, c, t, g, unknown or other
  misc_feature (257)..(257): n is a, c, g, or t
  modified_base (265)..(266): a, c, t, g, unknown or other
  misc_feature (265)..(266): n is a, c, g, or t
  modified_base (268)..(304): a, c, t, g, unknown or other
  misc_feature (268)..(304): n is a, c, g, or t
tcagagtcgagagacacgaccggtgctcgatttagctacgctctaagggacacgggccaccctgaccatcagcagggtcgaaggccgggggatgaggccgactattactgtcacgtgtggacagtagtagtgatcatggtggtgttcggcggagggaccaagctgaccgtctaggtcagcccaggctcgccccctcggtcactcctcgttcccccgcccttcctctctctcgactctgaggcggctggacaaggtcncagtgctnncnnnnnnnnnnnnnnnnnnnnnnnnnnnnnnnnnnnnn

SEQ ID NO: 173866 - DNA, 282 bp, Homo sapiens
  misc_feature: GYAE6OF01C9XX1.49.65.F10.1.454.CMB.1.raw
  modified_base (249)..(249): a, c, t, g, unknown or other
  misc_feature (249)..(249): n is a, c, g, or t
  modified_base (255)..(282): a, c, t, g, unknown or other
  misc_feature (255)..(282): n is a, c, g, or t
tcagagtcgagagacacgaccggtgctcgatttagctacgctctaagggacacggccaccctgaccatcagcagggtcgaagccgggatgaggccgactattactgtcacgtgtggacagtagtagtgatcatgtggtgttcggcggagggaccaagctgaccgtcctaggtcagcccaaggcctgcccccctggtcacgtctcgttccccaccctcctctctctcgactctgagcggctggcaaggcncatagnnnnnnnnnnnnnnnnnnnnnnnnnnnn

SEQ ID NO: 173867 - DNA, 289 bp, Homo sapiens
  misc_feature: GYAE6OF01DVES5.49.65.F10.1.454.CMB.1.raw
  modified_base (158)..(158): a, c, t, g, unknown or other
  misc_feature (158)..(158): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (270)..(289): a, c, t, g, unknown or other
  misc_feature (270)..(289): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcattggtgttcggcggagggactaanctgaccgtcctacggtcagcccaaggctcgccccctaccggtctactcgttcgttcccctacccgtccctctctcctcgactctggancgggcgtcgngaacggcncatagnnnnnnnnnnnnnnnnnnnn

SEQ ID NO: 173868 - DNA, 607 bp, Homo sapiens
  misc_feature: GYAE6OF01CK43I.49.65.F10.1.454.CMB.1.raw
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
tcagagtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcctgggaggtccctgagactctcctgtgaagcctctggattcaccttcaagaactttggcatgcacgtcggggtccgccgaggcctccgaggcgaccgggggctgggaggtgggtgggctaggttnctcagatggaataggtaaagtaaaagtacttaagttcggactcgtagacgggccgagttcacctatctaccagagacaattccaaagaacacttagactatactaanaaatcgacacgagtactagacgacctaggacggacacggctgttagtagttacgtggtaggacgggaagggggtacggggttagttttcggcttacggttaccggtaaccctagttacgtaaccgtaccgtacgggggcccgtaaacccgggg

SEQ ID NO: 173869 - DNA, 285 bp, Homo sapiens
  misc_feature: GYAE6OF01DP01W.49.65.F10.1.454.CMB.1.raw
  modified_base (264)..(285): a, c, t, g, unknown or other
  misc_feature (264)..(285): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttccccaccctcctctctctcgactctggagcgggtctcggcgaacggcgctagtagnnnnnnnnnnnnnnnnnnnnnn

SEQ ID NO: 173870 - DNA, 259 bp, Homo sapiens
  misc_feature: GYAE6OF01ALAYR.49.65.F10.1.454.CMB.1.raw
  modified_base (249)..(249): a, c, t, g, unknown or other
  misc_feature (249)..(249): n is a, c, g, or t
  modified_base (254)..(259): a, c, t, g, unknown or other
  misc_feature (254)..(259): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctgagcggctggcaggcgnatagnnnnnn

SEQ ID NO: 173871 - DNA, 281 bp, Homo sapiens
  misc_feature: GYAE6OF01AZBYR.49.65.F10.1.454.CMB.1.raw
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (255)..(281): a, c, t, g, unknown or other
  misc_feature (255)..(281): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttcccgccctcctctctctcgactctgagcggntggcaaggcncatagctnnnnnnnnnnnnnnnnnnnnnnnnnnn

SEQ ID NO: 173872 - DNA, 348 bp, Homo sapiens
  misc_feature: GYAE6OF01D88DU.49.65.F10.1.454.CMB.1.raw
  modified_base (323)..(323): a, c, t, g, unknown or other
  misc_feature (323)..(323): n is a, c, g, or t
  modified_base (329)..(348): a, c, t, g, unknown or other
  misc_feature (329)..(348): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgagccgactattactgtcacggtgtgggacagtagtagtgatcatggtggtgtcggacggagggaccaagctacgaccgtcgtaggtcacgcccaaggcctccgtcccccgtcggtccaccttccgtccgttcccccgccccttcctccttcctaccgtccgtacttctggacggcgggtcgtcggacaaggggccanagtagnnnnnnnnnnnnnnnnnnnn

SEQ ID NO: 173873 - DNA, 259 bp, Homo sapiens
  misc_feature: GYAE6OF01C3ZNX.49.65.F10.1.454.CMB.1.raw
  modified_base (248)..(248): a, c, t, g, unknown or other
  misc_feature (248)..(248): n is a, c, g, or t
  modified_base (252)..(259): a, c, t, g, unknown or other
  misc_feature (252)..(259): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatggtggtgttcggcggagggaccagctgaccgtctaggtcagcccaaggctcgccccctggtcactctcgttcccaccctctctctctcgactcgtgagcggctggacaggcncatnnnnnnnn

SEQ ID NO: 173874 - DNA, 276 bp, Homo sapiens
  misc_feature: GYAE6OF01AQXLD.49.65.F10.1.454.CMB.1.raw
  modified_base (262)..(276): a, c, t, g, unknown or other
  misc_feature (262)..(276): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctcgttccccaccctcctctctctcgactcgtcgagcgggctggcgaaggcgacgatagnnnnnnnnnnnnnnn

SEQ ID NO: 173875 - DNA, 300 bp, Homo sapiens
  misc_feature: GYAE6OF01BEP7O.49.65.F10.1.454.CMB.1.raw
  modified_base (288)..(300): a, c, t, g, unknown or other
  misc_feature (288)..(300): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccctggtcactctcgttcccaccctcctctctctcgactctgagcgggctggcaggcgcatagnnnnnnnnnnnnn

SEQ ID NO: 173876 - DNA, 257 bp, Homo sapiens
  misc_feature: GYAE6OF01EL6QB.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccccctggtcactctgttcccaccctcctctctctcgactctgagcgggctggcaaggcgcatagnnnn

SEQ ID NO: 173877 - DNA, 276 bp, Homo sapiens
  misc_feature: GYAE6OF01EOC65.49.65.F10.1.454.CMB.1.raw
  modified_base (255)..(276): a, c, t, g, unknown or other
  misc_feature (255)..(276): n is a, c, g, or t
tcagagtcgagagacacgaccggtgctcgatttagctacgctctaagggacgacggccaccctgaccatcagcagggtcgaagccggggatcgaggccgactattactgtcacgtgtgggacagtagtagtgatcatgtggtgttcggcggagggaccaagctgaccgtcctaggtcagcccaaggctgccccctggtcactcgtgtcccaccctcctctctctcgactctgagcgggctggcaaggcgcatagnnnnnnnnnnnnnnnnnnnnnn

SEQ ID NO: 173878 - DNA, 260 bp, Homo sapiens
  misc_feature: GYAE6OF01BWHPX.49.65.F10.1.454.CMB.1.raw
  modified_base (253)..(260): a, c, t, g, unknown or other
  misc_feature (253)..(260): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctcgaccgtcctaggtcagcccaaggctgcccctcggtcactctgttcccaccctcctctctctcgactctgagcggctggcaaggcgcatagnnnnnnnn

SEQ ID NO: 173879 - DNA, 910 bp, Homo sapiens
  misc_feature: GYAE6OF01B3KON.49.65.F10.1.454.CMB.1.raw
tcagagtcgagagacacgaccggtgctcgatttagctacgctctaagggggggagaggagcccagcactagaagtcggcggtgtttccattcggtgatcagcactgaacacagaggactcaccatgggagtttgggctaggagtcgttcgggttttcctcggttgtcttacgttttaaggaggttcgtccgagttcgtcgaggtcgcgaggtcgtgggtggacggtcggtagggggacggtcgtcggtaccaggtccggtaggggaccgtcccgtaggacgtacctccgtcgtgtacgaacgtccgtgttacggtaccttacctaccgtttaacgaaacggtttaaccgtttcggaactacgttcggacctacgggttcggggtccccacgtacgggtccctccggaagggccggtaaccgggggtcgtaggggtacggttcgggggtacgtaccgttaggttaccgttccgtacgtaaggtagtaacgggtaaggtaaacggggtaaaaacgttaaacggttacccgtttacgggttaccggtaccctttaccgggttaaggggaaaccgggtcccttaacgttaccccgaaacccgttagttacccgtaaccggaacggtaaacgtaccgttaaaccgttacccgaaacggtaaccgttaccgtaccgtaaccttacgttaaccgtaaaccgtaaacgtccgtaaccgtacgtacggttacgtaacgtaccgtaaccggtagaccgggtaaccgtacggttccgttaggttaccttaggttacgtcgggtacgggtaacggggttaggggggttaggtttacggttttacgggacgtttacggtaccggttaacccgtacggttaacggtaccggttacgggtaccggggtcccgttaaacccggggg

SEQ ID NO: 173880 - DNA, 274 bp, Homo sapiens
  misc_feature: GYAE6OF01DGECM.49.65.F10.1.454.CMB.1.raw
  modified_base (176)..(176): a, c, t, g, unknown or other
  misc_feature (176)..(176): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (259)..(261): a, c, t, g, unknown or other
  misc_feature (259)..(261): n is a, c, g, or t
  modified_base (263)..(274): a, c, t, g, unknown or other
  misc_feature (263)..(274): n is a, c, g, or t
tcagagtcgagagacacgaccggtgctcgatttagctacgctctaagggacacggccaccctgaccatcagcgagggtcgaagccggggatggaggccgactattactgtcacgtgtggacagtagtagtgatcattggtggtgttcggcggaggaccaagctgccgtccaggtcngcccaagctcgcccctggtcacctctccgtacccnccctcctcncctctcgactcgnggacgcggacngacgagacgtcagannntnnnnnnnnnnnn

SEQ ID NO: 173881 - DNA, 275 bp, Homo sapiens
  misc_feature: GYAE6OF01EUXDQ.49.65.F10.1.454.CMB.1.raw
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (266)..(275): a, c, t, g, unknown or other
  misc_feature (266)..(275): n is a, c, g, or t
tcagagtcgagagacacgaccggtgctcgatttagctacgctctaagggacacggccaccctgaccatcagcagggtcgaagccggggatgaggccgatattactgtcacgtgtgggacagtagtagtgatcatgtggtgtcggcggaggacagctgaccgtctaggtcacgcccgaggcctccgcccccgtggtctactccttccgttcccccacccttcctctcctctcgactcgnggacggcggtctggacacggcacagngnnnnnnnnnn

SEQ ID NO: 173882 - DNA, 276 bp, Homo sapiens
  misc_feature: GYAE6OF01DEUJU.49.65.F10.1.454.CMB.1.raw
  modified_base (258)..(258): a, c, t, g, unknown or other
  misc_feature (258)..(258): n is a, c, g, or t
  modified_base (264)..(276): a, c, t, g, unknown or other
  misc_feature (264)..(276): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatggtggtgttcggcggagggaccagctgaccgtctaggtcacgccaggctcgccccctcggtcacgtcctcgttccccaccctcctctctctcgactcgtgacggcggcgtggacgaacggcncatagnnnnnnnnnnnnn

SEQ ID NO: 173883 - DNA, 293 bp, Homo sapiens
  misc_feature: GYAE6OF01DLZZF.49.65.F10.1.454.CMB.1.raw
  modified_base (249)..(293): a, c, t, g, unknown or other
  misc_feature (249)..(293): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgtcggcggaggacaagctgaccgtctaggtcagcccaaggctcgccccctggtcactctgtcccacctctctctctcgactctgagcggctggacgaaggcgctatgcnnnnnnnnnnnnnnnnnnnnnnnnnnnnnnnnnnnnnnnnnnnnn

SEQ ID NO: 173884 - DNA, 301 bp, Homo sapiens
  misc_feature: GYAE6OF01EH0D6.49.65.F10.1.454.CMB.1.raw
  modified_base (259)..(301): a, c, t, g, unknown or other
  misc_feature (259)..(301): n is a, c, g, or t
tcagagtcgagagacacgaccggtgctcgatttagctacgctctaagggacacggccaccctgaccatcagcagggtcgaagccgggatgagccgactattactgtcacgtgtgggacagtagtagtgatcatgtggtgttcggcggaggaccaagctgaccgtctaggtcagcccaaggctgccccctaggtcactctcgtccccacctctctctctcgactctacgagccgggctagggaccaagggctcaataggnnnnnnnnnnnnnnnnnnnnnnnnnnnnnnnnnnnnnnnnnnn

SEQ ID NO: 173885 - DNA, 685 bp, Homo sapiens
  misc_feature: GYAE6OF01CE2ZB.49.65.F10.1.454.CMB.1.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagagtcgagagacacgaccggtgctcgatttagctacgctctaagggggggagaggagcccagcactagaagtcggcggtgtttccattcggtgatcagcactgaacacagagactcaccatggagtttgggctgagcttgggttttcctcgttgcttcttttaagaggtgtccagtgtcaggtgcagcgtggtggagtcgtgggggagcgtggtccagccgtgggacgtccctgagactctccgtgtgaacgcctntggacttccaccttacaagtactttggctagtcgcgtacgtcggggtcccncgacggcctaccgaggccggacggggctgggaggtgggtcgacgttagttatccgtagagtagtaggtaagtaaggaaaagttaaagtcgttagtaccgtacttcgttagggacgggtccgtattaccgacctatccgtacgaagacgtaacctaactacccgaaagaaccgtactacgactactactaacgaacgtcgacactacgtactagaaccgtacgaggacgtaacgtcgacgttagtagttacttacgggtaggtacgggaacgggggtaaggggggttacggtttattttaccgggacgttacggttacccggtacccttacggttacgacccggttacgggacccggggtccggtaaaccccgggg

SEQ ID NO: 173886 - DNA, 265 bp, Homo sapiens
  misc_feature: GYAE6OF01ENKAW.49.65.F10.1.454.CMB.1.raw
  modified_base (255)..(265): a, c, t, g, unknown or other
  misc_feature (255)..(265): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtctaggtcagcccaaggctcgccccctggtcactctgttcccgccctcctctctctcgactctgagcgggctggcaaggcgacatagnnnnnnnnnnn

SEQ ID NO: 173887 - DNA, 866 bp, Homo sapiens
  misc_feature: GYAE6OF01D7I8V.49.65.F10.1.454.CMB.1.raw
  modified_base (136)..(136): a, c, t, g, unknown or other
  misc_feature (136)..(136): n is a, c, g, or t
  modified_base (149)..(149): a, c, t, g, unknown or other
  misc_feature (149)..(149): n is a, c, g, or t
tcagagtcgagagacacgaccggtgctcgatttagctacgctctaaggggggagaggagcccagcactagaagtcggcggtgttccattcggtgatcagcactgaacacagagactcaccatggagtttggctgancttgggttttccncgttgcttacttttaagaggttgtccagtgtcaggtgcagtctggtggagtcgtgggggagcgtggtaccagccgtggggacgtccctggacacgtcctccgtgtgaagtccgttctggtacttaccacccgttctaaacggtaacgttttggactaatgccaacgttcgggttccgcccctaagggccttccgaagggtccgaaccggggcgttcgggaacggttgggggtcggtaccgtaggttttaaacgtccgttacgaacggtaagttaggtaaataccgggggttaaaaggttaaaaaaaccggttacgttaacgtttacccgggtaaacccgttacccgttttacggggaaacggggcccggtaaacttttacccgaaacccctaagtttacccgttaacccggaaacggtaacggtaaacctaaaacgttaccccgtaaaagaaacccgtaaccgtttacgaccttaaagttacccgaaacctaaacgtacgtaacaaccttaaggtaccgttacgaacgtaaacccgtacggtaacggtaccggttaacggccgtttacgttagtttaaaccgttacgttaccgggttaggtaaccggggtaagggggggttaaggtttagttttacgggtaacctttacgggttaccgtaccccgttaacggtttacgtaacggttacccggtacggggtccggttaaaccccgggg

SEQ ID NO: 173888 - DNA, 451 bp, Homo sapiens
  misc_feature: GYAE6OF01BBDYW.49.65.F10.1.454.CMB.1.raw
  modified_base (411)..(451): a, c, t, g, unknown or other
  misc_feature (411)..(451): n is a, c, g, or t
tcagagtcgagagacacgaccggtgctcgatttagctacgctctaagggcacgaccggtgctcgatttagctacgctctagggggacacggccaccctgaccatcagcagggtcgaagccggggatgaggccgactattactgtcacgtgtgggacgagtagtagtgactctagtggtggttcggttccgggacggggaacggaaaccgagtcgtacggtaccccgttacgttacggtacgacccgacccggaacggtcctccccggtccccccgttccggtacctacccgtttccgtttaccccgtttacccccctacccccctttcccttccgttcccttaccgtacccggttaccttcggtaggaccggggccgggtcggtccggaaccggaacgggccactagtagnnnnnnnnnnnnnnnnnnnnnnnnnnnnnnnnnnnnnnnnn

SEQ ID NO: 173889 - DNA, 261 bp, Homo sapiens
  misc_feature: GYAE6OF01ARGLO.49.65.F10.1.454.CMB.1.raw
  modified_base (257)..(261): a, c, t, g, unknown or other
  misc_feature (257)..(261): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctagtcagcccaggctcgccccctggtcactctcgttccccaccctcctctctctcgactctgagcgggcgtggcgaacggcgcatagnnnnn

SEQ ID NO: 173890 - DNA, 284 bp, Homo sapiens
  misc_feature: GYAE6OF01DUR5D.49.65.F10.1.454.CMB.1.raw
  modified_base (254)..(284): a, c, t, g, unknown or other
  misc_feature (254)..(284): n is a, c, g, or t
tcagagtcgagagacacgaccggtgctcgatttagctacgctctaaggggacgacggccaccctgaccatcgagcagggtcgaagccggggatgaggccgactattactgtcacgtgtggacagtagtagtgatcatggtggtgttcggcggagggaccaagctgaccgtcctaggtcagccaaggctcgcccctggtcactctcgttcccacctctctctctccgactctgacggcggtctgcacgcgcatannnnnnnnnnnnnnnnnnnnnnnnnnnnnnn

SEQ ID NO: 173891 - DNA, 696 bp, Homo sapiens
  misc_feature: GYAE6OF01D7YNK.49.65.F10.1.454.CMB.1.raw
  modified_base (392)..(392): a, c, t, g, unknown or other
  misc_feature (392)..(392): n is a, c, g, or t
  modified_base (529)..(529): a, c, t, g, unknown or other
  misc_feature (529)..(529): n is a, c, g, or t
tcagagtcgagagacacgaccggtgctcgatttagctacgctctaagggggggagaggagcccagcactagaagtcggcggtgtttccattcggtgatcagcactgaacacagagactcaccatggagtttgggctgagctgggttttcctcgttgcttacgttttaagaggtgtccagtgtcaggtgcagcgtggtggagtcgtgggggagcgtggtccagccgtagggacggttcccaggactacgtcctccgtaggtagaacgtcctcgtggtaacttaccgtaccttacgaaagtaactttcggacaagtcgactacgtcgggtacccacgacggacctaccggaggacggacggggcgtagggtaggtgggcggtactaagtttacnctacgaggtatagtaagtaacgggtaaaagttaaaaacgtcgttaacgttacggtaacgtccgttaacggaacgggtaccgtaataccgaacctacgtctaacgaagtacgaactaactacgaaacgaactacgtanactatactaacaatgacaatactacgtagaacgtcacgaacgtacgacgtgtacgtgtaacttacggtgtagggacggggtaaaggggttacggtttatttggacgttaacggttcgtaaacccttaggttacgacggttaacggtcggggtaccctaaacccgggg

SEQ ID NO: 173892 - DNA, 369 bp, Homo sapiens
  misc_feature: GYAE6OF01CLXCG.49.65.F10.1.454.CMB.1.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (307)..(369): a, c, t, g, unknown or other
  misc_feature (307)..(369): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccactattactgtcacgtgtgggacagtagtagtgatcatgtggtgtcggnggaggacagctgaccgtctagcagacccaggcctccgccccctggtacnctctccgttaccccncctcctctctctcgtactgngtacggcggtntcgggacaaggggtcncaaagtggatcagcannnnnnnnnnnnnnnnnnnnnnnnnnnnnnnnnnnnnnnnnnnnnnnnnnnnnnnnnnnnnnn

SEQ ID NO: 173893 - DNA, 797 bp, Homo sapiens
  misc_feature: GYAE6OF01D73KD.49.65.F10.1.454.CMB.1.raw
  modified_base (234)..(234): a, c, t, g, unknown or other
  misc_feature (234)..(234): n is a, c, g, or t
  modified_base (660)..(660): a, c, t, g, unknown or other
  misc_feature (660)..(660): n is a, c, g, or t
  modified_base (680)..(680): a, c, t, g, unknown or other
  misc_feature (680)..(680): n is a, c, g, or t
  modified_base (771)..(771): a, c, t, g, unknown or other
  misc_feature (771)..(771): n is a, c, g, or t
tcagagtcgagagacacgaccggtgctcgatttagctacgctctaagggggggagaggagcccagcactagaagtcggcggttgtttccattcggtgatcagcactgaacacagagactcaccagtggtagtttgggctgagtcgttgggttttcctcgtttgtctttacttttaagaggttcgtccagttgtcgtaggtgcagtcgtggggtggtacgttcgggtaggggggnggtcggtcggtccgacggtccggtggggaccggttccctaggacgtaccttcctccgttgtacgacgtccgttacgtcgttaccttacctaaccgttacgtaaacggttacgtttggacctagtcgaccgtcggtccggtccgaccgtacggccgtccggacgggtccgggaccgggtcgggtaggggtagggtcgggtacggtcgttaacgtttgtaccgttagaggttaagtacgaaggttaaagtaaaacgttaaaacgttcgtttaacgtacggtaaccttacggttaagggaccggttacctacgttaccacgtcttacgacgaagtaacctaacgtaacttacgaaactactcttacgactacttaacctaatactcgactacgtactcgtacgtaacgaccgtagggactacggtcgtnttacgtgtttaacggttagnggggttacgggtaagggggtacgggggttaggttttacttacgggtacttacgggtacccttaacccgggtttagtaaccggttacccggnggggttaacccgggcggttacccggg

SEQ ID NO: 173894 - DNA, 262 bp, Homo sapiens
  misc_feature: GYAE6OF01B2JB1.49.65.F10.1.454.CMB.1.raw
  modified_base (248)..(248): a, c, t, g, unknown or other
  misc_feature (248)..(248): n is a, c, g, or t
  modified_base (253)..(262): a, c, t, g, unknown or other
  misc_feature (253)..(262): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggaggaccaagctgaccgtcctaggtcagcccaaggctcgccccctggtcactctcgttcccaccctcctctctctcgactctgaggcggctggcaggcnagtannnnnnnnnn

SEQ ID NO: 173895 - DNA, 346 bp, Homo sapiens
  misc_feature: GYAE6OF01BXH8M.49.65.F10.1.454.CMB.1.raw
  modified_base (258)..(258): a, c, t, g, unknown or other
  misc_feature (258)..(258): n is a, c, g, or t
  modified_base (266)..(270): a, c, t, g, unknown or other
  misc_feature (266)..(270): n is a, c, g, or t
  modified_base (277)..(277): a, c, t, g, unknown or other
  misc_feature (277)..(277): n is a, c, g, or t
  modified_base (279)..(346): a, c, t, g, unknown or other
  misc_feature (279)..(346): n is a, c, g, or t
tcagagtcgagagacacgaccggtgctcgatttagctacgctctaagggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgcccccctcggtcactctcgtccccaccctcctctcctctcgtactctagagcgggctgggaccaaggngcatagcnnnnngcatacngnnnnnnnnnnnnnnnnnnnnnnnnnnnnnnnnnnnnnnnnnnnnnnnnnnnnnnnnnnnnnnnnnnnn

SEQ ID NO: 173896 - DNA, 297 bp, Homo sapiens
  misc_feature: GYAE6OF01CJBL8.49.65.F10.1.454.CMB.1.raw
  modified_base (265)..(297): a, c, t, g, unknown or other
  misc_feature (265)..(297): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctcggtcactctccgttcccacccttcctctctctcgactctggagcgggtcaggacgaacgggcacatagcnnnnnnnnnnnnnnnnnnnnnnnnnnnnnnnnn

SEQ ID NO: 173897 - DNA, 802 bp, Homo sapiens
  misc_feature: GYAE6OF01EAREZ.49.65.F10.1.454.CMB.1.raw
tcagagtcgagagacacgaccggtgctcgatttagctacgctctaaggggggagaggagcccagcactagaagtcggcggtgtttccattcggtgatcagcactgaacacagagactcaccatggagtttgggctgagcttgggttttcctcgttgtctcttttaagaggtgtcattgtcaggtgctagttaagtggaggtcgggggatcgtgtcgggtccggccgtgggacggtccctgacgcctcgtcctgtcgcacgtccctaccggtattacgaacgttcgggaactagtcggtccttacgcgtcggtccgccgaggtcctcccgaggcgaagggggtcgtaggggtaggtgggggtcggtcttaaggtttacttttcgatttacgtaggttactttacgaagtttattagggtaatttaacgttacgggaacgtaaaggttacgggtttaacccgggtttaaaggggaccccgtaagtttacccaaaccttacgtacccttaccggaaaggtaacccgtaacgtaaaacctttaccccgaaaacgtaaacccctacccctttaaggttaacctacgttcgaacttaacgttaacggtaaacaccgtaacgtacgtaacgtacgacgttagggaaccgtaagtaccgggtacttaggttaacgttatttacggttaggtacgtaaggtaaaaccgtttggttaaagtacggttaacggttaaagtttacggtttcgggttttaacggtaggttattaccggtaagtaagttttaacggtaaggggttcgttaacgggg

SEQ ID NO: 173898 - DNA, 336 bp, Homo sapiens
  misc_feature: GYAE6OF01BC4CS.49.65.F10.1.454.CMB.1.raw
  modified_base (147)..(147): a, c, t, g, unknown or other
  misc_feature (147)..(147): n is a, c, g, or t
  modified_base (276)..(276): a, c, t, g, unknown or other
  misc_feature (276)..(276): n is a, c, g, or t
  modified_base (278)..(336): a, c, t, g, unknown or other
  misc_feature (278)..(336): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggnggacgggacagctgccgtactagtcacgccgaaggcctcgccccctgtctacgtccgtcttccccacccgttctcctcctactccgtatctgggacggcggtcgtcgggaacgtacggcgtactagtgngnnnnnnnnnnnnnnnnnnnnnnnnnnnnnnnnnnnnnnnnnnnnnnnnnnnnnnnnnnn

SEQ ID NO: 173899 - DNA, 269 bp, Homo sapiens
  misc_feature: GYAE6OF01CMQQK.49.65.F10.1.454.CMB.1.raw
  modified_base (258)..(269): a, c, t, g, unknown or other
  misc_feature (258)..(269): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctcgccccctggtcactctcgttccccaccctcctctctctcgactctgagcgggctggcaaggcgacatagnnnnnnnnnnnn

SEQ ID NO: 173900 - DNA, 304 bp, Homo sapiens
  misc_feature: GYAE6OF01DNTS1.49.65.F10.1.454.CMB.1.raw
  modified_base (260)..(260): a, c, t, g, unknown or other
  misc_feature (260)..(260): n is a, c, g, or t
  modified_base (268)..(304): a, c, t, g, unknown or other
  misc_feature (268)..(304): n is a, c, g, or t
tcagagtcgagagacacgaccggtgctcgatttagctacgctctaagggggacacggccacctgaccatcagcagggtcgaagccggggatggaggccgactattactgtcacgtgtgggacagtagtagtgatcatgtggtgttcggcggaggacaagctgaccgtctaggtcagccaagggctcgccccgtggtacacttctccgttcccacctcctctcgtctcgactcgtaggcggcggtcgtgggacgaagggcncaagtgannnnnnnnnnnnnnnnnnnnnnnnnnnnnnnnnnnnn

SEQ ID NO: 173901 - DNA, 649 bp, Homo sapiens
  misc_feature: GYAE6OF01BVUO6.49.65.F10.1.454.CMB.1.raw
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
  modified_base (505)..(505): a, c, t, g, unknown or other
  misc_feature (505)..(505): n is a, c, g, or t
tcagagtcgagagacacgaccggtgctcgatttagctacgctctaagggggggagaggagcccagcactagaagtcggcggtgttccattcggtgatcagcactgaacacgagaggacctcaccagtggtagtttgggctgagcgtggtttcgcgtagctctttaagaggtntcagtgcaggtncagtcgtgggtggtagtggtgggggagtcgtggtaccagtccgtgggacgtccctagacgccttcgtcgttgacggactccgtctggtaactccgtaaccctagtaacggtaccgttggacctagtccgacgttaaccgtcgggaccccacgcggtcctcggaacgggtcgaccgggtggtggaggttggacggtataggttcgtacagtagngtagaagtaccggtaaaagtaactacttgacggtactgtaggcgtcntacgcattcganacgtaacgactaactactaagtaacctcctagactacggtacaccgtancgactacgagtaccagactcggacgacgtcttcgtgttacgtagtacgttgggtacggtaggaggggttacggttacgtttagttacggacgtacgtacccgttcgtacgttaacggaccggtaccgggtggtaacccgtacgg

SEQ ID NO: 173902 - DNA, 594 bp, Homo sapiens
  misc_feature: GYAE6OF01DR4S6.49.65.F10.1.454.CMB.1.raw
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagagtcgagagacacgaccggtgctcgatttagctacgctctaagggtacgtacgggccaccctagaccatcagcgagggtcgaagccgggatgaggccgactattactgacacgtgtgggaccagtagtagtagattcatggtggtgttcggcggaggaccaagctcgaccgttactaggtcacgccaaggctcgcccccgtgtcactcgtcgtcccacctccgtctctctcacctcgtggtacggcggtctggacaacggcgacaagtgcgnacgntacncncgntacatcangctcgctagcaggtcnccttagattccggngtatacgngacgntcgagtactacgacgacgacgtacgagtactagtgacgcgacgtagtacgtacgtagacgtacgtacgacgtacgtacgtacgtacgttacgttacgttacggtacggtacgaacgtacgtacgtacgtacgtcgtacgtctacgtactacctaccgtaccgacgtacgtacgtaccgtacctccgtccgtccgaccgtcgtccgacgaccgcgaccacgtacgacgacacgtacgacgacgtccgcgtcgtcg

SEQ ID NO: 173903 - DNA, 254 bp, Homo sapiens; identical to SEQ ID NO: 173473
  misc_feature: GYAE6OF02FWCPK.49.65.F10.1.454.CMB.1.raw
  modified_base (253)..(254): a, c, t, g, unknown or other
  misc_feature (253)..(254): n is a, c, g, or t

SEQ ID NO: 173904 - DNA, 254 bp, Homo sapiens; identical to SEQ ID NO: 173473
  misc_feature: GYAE6OF02ICPZ0.49.65.F10.1.454.CMB.1.raw
  modified_base (253)..(254): a, c, t, g, unknown or other
  misc_feature (253)..(254): n is a, c, g, or t

SEQ ID NO: 173905 - DNA, 253 bp, Homo sapiens; identical to SEQ ID NO: 173454
  misc_feature: GYAE6OF02HWRAA.49.65.F10.1.454.CMB.1.raw
  modified_base (253)..(253): a, c, t, g, unknown or other
  misc_feature (253)..(253): n is a, c, g, or t

SEQ ID NO: 173906 - DNA, 253 bp, Homo sapiens
  misc_feature: GYAE6OF02GB1S7.49.65.F10.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgcccctcggtcactctgttcccacctcctctctctcgactctgagcgggctggcaaggcgcatagnnn

SEQ ID NO: 173907 - DNA, 255 bp, Homo sapiens; identical to SEQ ID NO: 173456
  misc_feature: GYAE6OF02GL5Y8.49.65.F10.1.454.CMB.1.raw
  modified_base (253)..(255): a, c, t, g, unknown or other
  misc_feature (253)..(255): n is a, c, g, or t

SEQ ID NO: 173908 - DNA, 280 bp, Homo sapiens
  misc_feature: GYAE6OF02IBXMX.49.65.F10.1.454.CMB.1.raw
  modified_base (256)..(280): a, c, t, g, unknown or other
  misc_feature (256)..(280): n is a, c, g, or t
tcagagtcgagagacacgaccggtgctcgatttagctacgctctaagggacgacgggccaccctgaccatcagcagggtcgaagccggggatgaggccgactattactgtcacgtgtgggacagtagtagtgatcatgtggtgttcggcggagggaccaagctgaccgtcctaggtccagcccaaggctgccccctggtcactctgttcccgcccttcctctctctcgactctgagcgggctggcaaggcgcatgnnnnnnnnnnnnnnnnnnnnnnnnn

SEQ ID NO: 173909 - DNA, 255 bp, Homo sapiens; identical to SEQ ID NO: 173604
  misc_feature: GYAE6OF02GLVHY.49.65.F10.1.454.CMB.1.raw
  modified_base (254)..(255): a, c, t, g, unknown or other
  misc_feature (254)..(255): n is a, c, g, or t

SEQ ID NO: 173910 - DNA, 248 bp, Homo sapiens
  misc_feature: GYAE6OF02FH3WJ.49.65.F10.1.454.CMB.1.raw
  modified_base (248)..(248): a, c, t, g, unknown or other
  misc_feature (248)..(248): n is a, c, g, or t
tcagagtcgagagacacgaccggtgctcgatttagctacgctctaaggacacggccacctgaccatcagcagggtcgaagccgggatgaggccgactattactgtcacgtgtggacagtagtagtgatcatgtggtgttcggcggagggaccaagctgaccgtcctaggtcagcccaaggctgcccctcggtcactctgttcccacctcctctctctcgactctgagcgggctggcaaggcgcatagn

SEQ ID NO: 173911 - DNA, 256 bp, Homo sapiens
  misc_feature: GYAE6OF02GFI47.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccgactattactgtcacgtttgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnn

SEQ ID NO: 173912 - DNA, 535 bp, Homo sapiens
  misc_feature: GYAE6OF02HZU0J.49.65.F10.1.454.CMB.1.raw
  modified_base (264)..(264): a, c, t, g, unknown or other
  misc_feature (264)..(264): n is a, c, g, or t
  modified_base (266)..(267): a, c, t, g, unknown or other
  misc_feature (266)..(267): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
tcagagtcgagagacacgaccggtgctcgatttagctacgctctaagggtacgacgggccgaccctggaccgatcagcagggtcgaagccgggatgaggccgacgtattacctgtcacgtcgtggacagtacgtagtgatcagtgtggtgttcggcggaggaccaagctgaccgtcctaggtcagcccaaggctgccccctggtccactctgtcccgaccctcctctctctcgactctgacgcggctggctaaggcgacatagntnntgcagcnaagcagcagtccatctgattgngtgagancncngngcgcgngngcgtcgtgngcgntctcgcgcncgcgcgcgcgacgactcgtcgcgtacgacgacgtcgacgcgacgcgacgtacgacgacgacgacgcgtcgtagtactagtacgacgacgacgacgacgtacgtacgtacgtacgtagtacgtacgtacgtacgtacgtacgtacgacgtacgtacgtacgtacgtacgacgacgaccgaccgacgtccgtccgtcg

SEQ ID NO: 173913 - DNA, 259 bp, Homo sapiens
  misc_feature: GYAE6OF02JUCNZ.49.65.F10.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctcctctctctcactctgagcgggctggcaaggcgcatagnnnnnnnn

SEQ ID NO: 173914 - DNA, 306 bp, Homo sapiens
  misc_feature: GYAE6OF02G4L76.49.65.F10.1.454.CMB.1.raw
  modified_base (269)..(269): a, c, t, g, unknown or other
  misc_feature (269)..(269): n is a, c, g, or t
  modified_base (271)..(306): a, c, t, g, unknown or other
  misc_feature (271)..(306): n is a, c, g, or t
tcagagtcgagagacacgaccggtgctcgatttagctacgctctaagggacgacgggccaccctgaccatcacgcagggtcgaagccggggatcgaggccgactattactgtcacgtgtgggacagtagtagtgactcatgtgggtgttcggcggtagggaccaagctgacccgtcctaggtccagccctaaggctgcccccgtaggtcacctcctgttccccaccctcctctcctctcgactctgagcgggctggcaaggcgcatagnannnnnnnnnnnnnnnnnnnnnnnnnnnnnnnnnnnn

SEQ ID NO: 173915 - DNA, 256 bp, Homo sapiens
  misc_feature: GYAE6OF02JGG1F.49.65.F10.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgcctcctctctctcgactctgagcgggctggcaaggcgcatagnnnnn

SEQ ID NO: 173916 - DNA, 288 bp, Homo sapiens
  misc_feature: GYAE6OF02IFQ1F.49.65.F10.1.454.CMB.1.raw
  modified_base (288)..(288): a, c, t, g, unknown or other
  misc_feature (288)..(288): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagn

SEQ ID NO: 173917 - DNA, 254 bp, Homo sapiens; identical to SEQ ID NO: 173581
  misc_feature: GYAE6OF02IMLKB.49.65.F10.1.454.CMB.1.raw
  modified_base (254)..(254): a, c, t, g, unknown or other
  misc_feature (254)..(254): n is a, c, g, or t

SEQ ID NO: 173918 - DNA, 255 bp, Homo sapiens
  misc_feature: GYAE6OF02JDCWE.49.65.F10.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctgactctgagcgggctggcaaggcgcatagnnnn

SEQ ID NO: 173919 - DNA, 251 bp, Homo sapiens
  misc_feature: GYAE6OF02F9S3T.49.65.F10.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgcccctcggtcactctgttcccacctcctctctctcgactctgagcgggctggcaaggcgcatagn

SEQ ID NO: 173920 - DNA, 283 bp, Homo sapiens
  misc_feature: GYAE6OF02G75P0.49.65.F10.1.454.CMB.1.raw
  modified_base (258)..(283): a, c, t, g, unknown or other
  misc_feature (258)..(283): n is a, c, g, or t
tcagagtcgagagacacgaccggtgctcgatttagctacgctctaagggacgacgggccaccctgaccatcagcagggtcgaagccggggatgaggccgactagttactggtcacgtgtgggacagtagtagtgatcgatgtggtgttcggcgggagggactaagctgaccgtcctaggtcagcccaaggctgcccctcggtcactctgttcccgccctcctctcctcgactctgagcgggctggcaaggcgcatagnnnnnnnnnnnnnnnnnnnnnnnnnn

SEQ ID NO: 173921 - DNA, 255 bp, Homo sapiens; identical to SEQ ID NO: 173459
  misc_feature: GYAE6OF02IJQT1.49.65.F10.1.454.CMB.1.raw
  modified_base (253)..(255): a, c, t, g, unknown or other
  misc_feature (253)..(255): n is a, c, g, or t

SEQ ID NO: 173922 - DNA, 255 bp, Homo sapiens; identical to SEQ ID NO: 173465
  misc_feature: GYAE6OF02H0JYI.49.65.F10.1.454.CMB.1.raw
  modified_base (254)..(255): a, c, t, g, unknown or other
  misc_feature (254)..(255): n is a, c, g, or t

SEQ ID NO: 173923 - DNA, 290 bp, Homo sapiens
  misc_feature: GYAE6OF02I6RG3.49.65.F10.1.454.CMB.1.raw
  modified_base (288)..(290): a, c, t, g, unknown or other
  misc_feature (288)..(290): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagnnn

SEQ ID NO: 173924 - DNA, 289 bp, Homo sapiens
  misc_feature: GYAE6OF02GHSRV.49.65.F10.1.454.CMB.1.raw
  modified_base (288)..(289): a, c, t, g, unknown or other
  misc_feature (288)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173925 - DNA, 255 bp, Homo sapiens; identical to SEQ ID NO: 173604
  misc_feature: GYAE6OF02G9V4U.49.65.F10.1.454.CMB.1.raw
  modified_base (254)..(255): a, c, t, g, unknown or other
  misc_feature (254)..(255): n is a, c, g, or t

SEQ ID NO: 173926 - DNA, 255 bp, Homo sapiens; identical to SEQ ID NO: 173459
  misc_feature: GYAE6OF02GR1NH.49.65.F10.1.454.CMB.1.raw
  modified_base (253)..(255): a, c, t, g, unknown or other
  misc_feature (253)..(255): n is a, c, g, or t

SEQ ID NO: 173927 - DNA, 253 bp, Homo sapiens
  misc_feature: GYAE6OF02IVVYF.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcggctggcaaggcgcatagn

SEQ ID NO: 173928 - DNA, 300 bp, Homo sapiens
  misc_feature: GYAE6OF02GQBVO.49.65.F10.1.454.CMB.1.raw
  modified_base (288)..(300): a, c, t, g, unknown or other
  misc_feature (288)..(300): n is a, c, g, or t
tcagagtcgagagacacgaccggtgctcgatttagctacgctctaagggcgacgaccggtgctcgatttagctacgctctaaggggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnnnnnnnnnn

SEQ ID NO: 173929 - DNA, 255 bp, Homo sapiens; identical to SEQ ID NO: 173456
  misc_feature: GYAE6OF02GXN5V.49.65.F10.1.454.CMB.1.raw
  modified_base (253)..(255): a, c, t, g, unknown or other
  misc_feature (253)..(255): n is a, c, g, or t

SEQ ID NO: 173930 - DNA, 281 bp, Homo sapiens
  misc_feature: GYAE6OF02GNKW8.49.65.F10.1.454.CMB.1.raw
  modified_base (253)..(281): a, c, t, g, unknown or other
  misc_feature (253)..(281): n is a, c, g, or t
tcagagtcgagagacacgaccggtgctcgatttagctacgctctaagggacacggccaccctgaccatcagcaggtcgaagccgggatgaggccgactacttactgtcacgtgtgggaccagtagtagtgatcatgtggtgttcggcggagggaccaagctgaccgtcctaggtcagcccaaggctgccccctggtcactctgttcccgccctctctctctcgactctgacgcgggctggcaaggcgcatagnnnnnnnnnnnnnnnnnnnnnnnnnnnnn

SEQ ID NO: 173931 - DNA, 257 bp, Homo sapiens; identical to SEQ ID NO: 173534
  misc_feature: GYAE6OF02G2GIT.49.65.F10.1.454.CMB.1.raw
  modified_base (254)..(257): a, c, t, g, unknown or other
  misc_feature (254)..(257): n is a, c, g, or t

SEQ ID NO: 173932 - DNA, 267 bp, Homo sapiens
  misc_feature: GYAE6OF02IGB3J.49.65.F10.1.454.CMB.1.raw
  modified_base (255)..(267): a, c, t, g, unknown or other
  misc_feature (255)..(267): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggccaaggcgcatagnnnnnnnnnnnnn

SEQ ID NO: 173933 - DNA, 258 bp, Homo sapiens
  misc_feature: GYAE6OF02FV4MK.49.65.F10.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnnnnnn

SEQ ID NO: 173934 - DNA, 261 bp, Homo sapiens
  misc_feature: GYAE6OF02H2H52.49.65.F10.1.454.CMB.1.raw
  modified_base (256)..(261): a, c, t, g, unknown or other
  misc_feature (256)..(261): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctccgtctctctcgcgactctgagcgggctggcaaggcgcatagnnnnnn

SEQ ID NO: 173935 - DNA, 257 bp, Homo sapiens; identical to SEQ ID NO: 173609
  misc_feature: GYAE6OF02GC9O0.49.65.F10.1.454.CMB.1.raw
  modified_base (254)..(257): a, c, t, g, unknown or other
  misc_feature (254)..(257): n is a, c, g, or t

SEQ ID NO: 173936 - DNA, 255 bp, Homo sapiens; identical to SEQ ID NO: 173456
  misc_feature: GYAE6OF02GMIFM.49.65.F10.1.454.CMB.1.raw
  modified_base (253)..(255): a, c, t, g, unknown or other
  misc_feature (253)..(255): n is a, c, g, or t

SEQ ID NO: 173937 - DNA, 326 bp, Homo sapiens
  misc_feature: GYAE6OF02G0J0R.49.65.F10.1.454.CMB.1.raw
  modified_base (270)..(276): a, c, t, g, unknown or other
  misc_feature (270)..(276): n is a, c, g, or t
  modified_base (278)..(326): a, c, t, g, unknown or other
  misc_feature (278)..(326): n is a, c, g, or t
tcagagtcgagagacacgaccggtgctcgatttagctacgctctaagggacacggcccaccctgaccatccagcagggtcgaagcccgggggatcgaggccgactattactgtcacgtgtgggacagtagtagtagatcatgtggtgttcggcggaggacctaagctgaccgtcctaggtcacgcccgaaggctccgccccctcggtcacttctgttcccaccctcctctactctccgactcgtcgagcgggctggtcaaggcgcatagnnnnnnncnnnnnnnnnnnnnnnnnnnnnnnnnnnnnnnnnnnnnnnnnnnnnnnnn

SEQ ID NO: 173938 - DNA, 255 bp, Homo sapiens; identical to SEQ ID NO: 173465
  misc_feature: GYAE6OF02FWF10.49.65.F10.1.454.CMB.1.raw
  modified_base (254)..(255): a, c, t, g, unknown or other
  misc_feature (254)..(255): n is a, c, g, or t

SEQ ID NO: 173939 - DNA, 255 bp, Homo sapiens; identical to SEQ ID NO: 173604
  misc_feature: GYAE6OF02HHK0P.49.65.F10.1.454.CMB.1.raw
  modified_base (254)..(255): a, c, t, g, unknown or other
  misc_feature (254)..(255): n is a, c, g, or t

SEQ ID NO: 173940 - DNA, 284 bp, Homo sapiens
  misc_feature: GYAE6OF02I540Q.49.65.F10.1.454.CMB.1.raw
  modified_base (256)..(260): a, c, t, g, unknown or other
  misc_feature (256)..(260): n is a, c, g, or t
  modified_base (262)..(284): a, c, t, g, unknown or other
  misc_feature (262)..(284): n is a, c, g, or t
tcagagtcgagagacacgaccggtgctcgatttagctacgctctaagggacgacgggccaccctgacccatcagcagggtcgaagccgggatgaggccgactattactgtcacgtgtgggacagtagtagtgatcatgtggtgttcggcggagggaccaagctgaccgtcctaggtccagcccaaggctgccccctggtcactctgttcccgccctctctctctcgactctgagcgggctgggcaaggcgcatagnnnnntnnnnnnnnnnnnnnnnnnnnnnn

SEQ ID NO: 173941 - DNA, 255 bp, Homo sapiens
  misc_feature: GYAE6OF02G8Z2S.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccccgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 173942 - DNA, 256 bp, Homo sapiens; identical to SEQ ID NO: 173524
  misc_feature: GYAE6OF02ITFQX.49.65.F10.1.454.CMB.1.raw
  modified_base (254)..(256): a, c, t, g, unknown or other
  misc_feature (254)..(256): n is a, c, g, or t

SEQ ID NO: 173943 - DNA, 256 bp, Homo sapiens
  misc_feature: GYAE6OF02FK92W.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgaggccaactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173944 - DNA, 256 bp, Homo sapiens
  misc_feature: GYAE6OF02GDDSS.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaagggacacggccaccctgaccatcagcagggtcgaagccggggatgagtccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173945 - DNA, 255 bp, Homo sapiens
  misc_feature: GYAE6OF02GV5KI.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaagccggggatgaggcagactattactgtcacgtgtgggacagtagtagtgatcatgtggtgttcggcggagggaccaagctgaccgtcctaggtcagtccaaggctgccccctcggtcactctgttcccaccctcctctctctcgactctgagcgggctggcaaggcgcatagnn

SEQ ID NO: 173946 - DNA, 308 bp, Homo sapiens
  misc_feature: GYAE6OF02GY2E6.49.65.F10.1.454.CMB.1.raw
  modified_base (267)..(308): a, c, t, g, unknown or other
  misc_feature (267)..(308): n is a, c, g, or t
tcagagtcgagagacacgaccggtgctcgatttagctacgctctaagggtacgtacgggccaccctgacccaatcgagcagggtcgaaagccggggatgaggccggacctattactgtcacgtgtggggacagtagtagtgatcgatgtggtgttcggcggagggaccaagctgaccgtcctaggtcagccccaaggctgccccctcggtcactctgttcccacctcctctctctcgactctgacgcgggctggcaaggcgcatagnnnnnnnnnnnnnnnnnnnnnnnnnnnnnnnnnnnnnnnnnn

SEQ ID NO: 173947 - DNA, 309 bp, Homo sapiens
  misc_feature: GYAE6OF02I211O.49.65.F10.1.454.CMB.1.raw
  modified_base (289)..(309): a, c, t, g, unknown or other
  misc_feature (289)..(309): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnnnnnnnnnnnnnnn

SEQ ID NO: 173948 - DNA, 260 bp, Homo sapiens
  misc_feature: GYAE6OF02F46MN.49.65.F10.1.454.CMB.1.raw
  modified_base (253)..(260): a, c, t, g, unknown or other
  misc_feature (253)..(260): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnn

SEQ ID NO: 173949 - DNA, 257 bp, Homo sapiens
  misc_feature: GYAE6OF02IP29I.49.65.F10.1.454.CMB.1.raw
  modified_base (256)..(257): a, c, t, g, unknown or other
  misc_feature (256)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctggccgtcctaggtcagcccaaggctcgccccctcggtcactctcgttcccgccctcctctctctcgactctgagcgggctggcaaggcgcatagnn

SEQ ID NO: 173950 - DNA, 302 bp, Homo sapiens
  misc_feature: GYAE6OF02G0ZNZ.49.65.F10.1.454.CMB.1.raw
  modified_base (288)..(302): a, c, t, g, unknown or other
  misc_feature (288)..(302): n is a, c, g, or t
tcagagtcgagagacacgaccggtgctcgatttagctacgctctaagggcgacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnnnnnnnn

SEQ ID NO: 173951 - DNA, 255 bp, Homo sapiens; identical to SEQ ID NO: 173574
  misc_feature: GYAE6OF02IVIG9.49.65.F10.1.454.CMB.1.raw
  modified_base (253)..(255): a, c, t, g, unknown or other
  misc_feature (253)..(255): n is a, c, g, or t

SEQ ID NO: 173952 - DNA, 253 bp, Homo sapiens
  misc_feature: GYAE6OF02I4231.49.65.F10.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgcctcctctctctcgactctgagcggctggcaaggcgcatagnn

SEQ ID NO: 173953 - DNA, 255 bp, Homo sapiens; identical to SEQ ID NO: 173465
  misc_feature: GYAE6OF02GDKBR.49.65.F10.1.454.CMB.1.raw
  modified_base (254)..(255): a, c, t, g, unknown or other
  misc_feature (254)..(255): n is a, c, g, or t

SEQ ID NO: 173954 - DNA, 256 bp, Homo sapiens
  misc_feature: GYAE6OF02HVQ0A.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgcctcctctctctcgactctgagcgggctggcaaggcgcatagnnnn

SEQ ID NO: 173955 - DNA, 255 bp, Homo sapiens; identical to SEQ ID NO: 173574
  misc_feature: GYAE6OF02I4AZ5.49.65.F10.1.454.CMB.1.raw
  modified_base (253)..(255): a, c, t, g, unknown or other
  misc_feature (253)..(255): n is a, c, g, or t

SEQ ID NO: 173956 - DNA, 305 bp, Homo sapiens
  misc_feature: GYAE6OF02HUYAI.49.65.F10.1.454.CMB.1.raw
  modified_base (258)..(260): a, c, t, g, unknown or other
  misc_feature (258)..(260): n is a, c, g, or t
  modified_base (262)..(263): a, c, t, g, unknown or other
  misc_feature (262)..(263): n is a, c, g, or t
  modified_base (265)..(305): a, c, t, g, unknown or other
  misc_feature (265)..(305): n is a, c, g, or t
tcagagtcgagagacacgaccggtgctcgatttagctacgctctaaggggacacgggccaccctgaccagtccagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnanncnnnnnnnnnnnnnnnnnnnnnnnnnnnnnnnnnnnnnnnnn

SEQ ID NO: 173957 - DNA, 254 bp, Homo sapiens; identical to SEQ ID NO: 173581
  misc_feature: GYAE6OF02GTCO7.49.65.F10.1.454.CMB.1.raw
  modified_base (254)..(254): a, c, t, g, unknown or other
  misc_feature (254)..(254): n is a, c, g, or t

SEQ ID NO: 173958 - DNA, 274 bp, Homo sapiens
  misc_feature: GYAE6OF02IUDFI.49.65.F10.1.454.CMB.1.raw
  modified_base (254)..(274): a, c, t, g, unknown or other
  misc_feature (254)..(274): n is a, c, g, or t
tcagagtcgagagacacgaccggtgctcgatttagctacgctctaagggacacgggccgaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcggctggcaaggcgcatagnnnnnnnnnnnnnnnnnnnnn

SEQ ID NO: 173959 - DNA, 290 bp, Homo sapiens; identical to SEQ ID NO: 173923
  misc_feature: GYAE6OF02FX0KC.49.65.F10.1.454.CMB.1.raw
  modified_base (288)..(290): a, c, t, g, unknown or other
  misc_feature (288)..(290): n is a, c, g, or t

SEQ ID NO: 173960 - DNA, 297 bp, Homo sapiens
  misc_feature: GYAE6OF02HSA0Z.49.65.F10.1.454.CMB.1.raw
  modified_base (264)..(275): a, c, t, g, unknown or other
  misc_feature (264)..(275): n is a, c, g, or t
  modified_base (277)..(297): a, c, t, g, unknown or other
  misc_feature (277)..(297): n is a, c, g, or t
tcagagtcgagagacacgaccggtgctcgatttagctacgctctaagggacggacggccaccctgaccatcagcagggtcgaagccggggatgaggcccgacgtattactgtcacgtgtgggaccagtagtagtgatcatggtggtggttcggcggagggaccaagctgaccgtcctaggtcagcccaaggctggccccctcggtcactctgttcccaccctcctctctctcgactctgagcgggctggcaaggtcgcgatagnnnnnnnnnnnncnnnnnnnnnnnnnnnnnnnnn

SEQ ID NO: 173961 - DNA, 257 bp, Homo sapiens; identical to SEQ ID NO: 173511
  misc_feature: GYAE6OF02H7S65.49.65.F10.1.454.CMB.1.raw
  modified_base (255)..(257): a, c, t, g, unknown or other
  misc_feature (255)..(257): n is a, c, g, or t

SEQ ID NO: 173962 - DNA, 255 bp, Homo sapiens
  misc_feature: GYAE6OF02I5UU5.49.65.F10.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnn

SEQ ID NO: 173963 - DNA, 301 bp, Homo sapiens
  misc_feature: GYAE6OF02HYY8Z.49.65.F10.1.454.CMB.1.raw
  modified_base (272)..(301): a, c, t, g, unknown or other
  misc_feature (272)..(301): n is a, c, g, or t
tcagagtcgagagacacgaccggtgctcgatttagctacgctctaagggacgacggccaccctgaccatcagccagggtcgaagccggggatacgaggccgactattactgtcacgtgtgggacagtagtagtgactcatgtggtagttccgggcggaagggtaccaagctgaccgtcctaggtccagcccaaggctgtccccctcggtcacgtactgttccccacccctcctctctctcgactctgacgcgggctggccaaggcgcatagnnnnnnnnnnnnnnnnnnnnnnnnnnnnnn

SEQ ID NO: 173964 - DNA, 255 bp, Homo sapiens; identical to SEQ ID NO: 173465
  misc_feature: GYAE6OF02HTML7.49.65.F10.1.454.CMB.1.raw
  modified_base (254)..(255): a, c, t, g, unknown or other
  misc_feature (254)..(255): n is a, c, g, or t

SEQ ID NO: 173965 - DNA, 260 bp, Homo sapiens
  misc_feature: GYAE6OF02FWRL7.49.65.F10.1.454.CMB.1.raw
  modified_base (254)..(260): a, c, t, g, unknown or other
  misc_feature (254)..(260): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnnnnnn

SEQ ID NO: 173966 - DNA, 257 bp, Homo sapiens
  misc_feature: GYAE6OF02F572K.49.65.F10.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagttgaccgtcctaggtcagcccaaggctgccccctcggtcactctgttcccaccctcctctctctcgactctgagcgggctggcaaggcgcatagnnn

SEQ ID NO: 173967 - DNA, 284 bp, Homo sapiens
  misc_feature: GYAE6OF02IFBNR.49.65.F10.1.454.CMB.1.raw
  modified_base (262)..(284): a, c, t, g, unknown or other
  misc_feature (262)..(284): n is a, c, g, or t
tcagagtcgagagacacgaccggtgctcgatttagctacgctctaaaggggacaacggccgaccctagaccactcagcagggtccgaagccgggatgaggccgactattactgtcacgtgtgggacagtagtagtgtatcatgtggtgttcggcggagggaccaaggctgaccgtcctaggtcagcccaaggctgccccctggtcactctgttcccaccctcctcgtctctcgactctgagcgggctggcaaggcgcatagnnnnnnnnnnnnnnnnnnnnnnn

SEQ ID NO: 173968 - DNA, 291 bp, Homo sapiens
  misc_feature: GYAE6OF02JAC2F.49.65.F10.1.454.CMB.1.raw
  modified_base (289)..(291): a, c, t, g, unknown or other
  misc_feature (289)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnn

SEQ ID NO: 173969 - DNA, 255 bp, Homo sapiens; identical to SEQ ID NO: 173465
  misc_feature: GYAE6OF02G4J0G.49.65.F10.1.454.CMB.1.raw
  modified_base (254)..(255): a, c, t, g, unknown or other
  misc_feature (254)..(255): n is a, c, g, or t

SEQ ID NO: 173970 - DNA, 254 bp, Homo sapiens; identical to SEQ ID NO: 173505
  misc_feature: GYAE6OF02HATUQ.49.65.F10.1.454.CMB.1.raw
  modified_base (253)..(254): a, c, t, g, unknown or other
  misc_feature (253)..(254): n is a, c, g, or t

SEQ ID NO: 173971 - DNA, 256 bp, Homo sapiens; identical to SEQ ID NO: 173524
  misc_feature: GYAE6OF02I1N5L.49.65.F10.1.454.CMB.1.raw
  modified_base (254)..(256): a, c, t, g, unknown or other
  misc_feature (254)..(256): n is a, c, g, or t

SEQ ID NO: 173972 - DNA, 289 bp, Homo sapiens
  misc_feature: GYAE6OF02GQSNQ.49.65.F10.1.454.CMB.1.raw
  modified_base (288)..(289): a, c, t, g, unknown or other
  misc_feature (288)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagnn

SEQ ID NO: 173973 - DNA, 256 bp, Homo sapiens
  misc_feature: GYAE6OF02GS8RD.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgaatctgagcggctggcaaggcgcatagnnnn

SEQ ID NO: 173974 - DNA, 256 bp, Homo sapiens; identical to SEQ ID NO: 173564
  misc_feature: GYAE6OF02IQPPO.49.65.F10.1.454.CMB.1.raw
  modified_base (253)..(256): a, c, t, g, unknown or other
  misc_feature (253)..(256): n is a, c, g, or t

SEQ ID NO: 173975 - DNA, 254 bp, Homo sapiens; identical to SEQ ID NO: 173581
  misc_feature: GYAE6OF02GQW7P.49.65.F10.1.454.CMB.1.raw
  modified_base (254)..(254): a, c, t, g, unknown or other
  misc_feature (254)..(254): n is a, c, g, or t

SEQ ID NO: 173976 - DNA, 254 bp, Homo sapiens; identical to SEQ ID NO: 173463
  misc_feature: GYAE6OF02GNQ50.49.65.F10.1.454.CMB.1.raw
  modified_base (254)..(254): a, c, t, g, unknown or other
  misc_feature (254)..(254): n is a, c, g, or t

SEQ ID NO: 173977 - DNA, 256 bp, Homo sapiens; identical to SEQ ID NO: 173592
  misc_feature: GYAE6OF02IQ5YT.49.65.F10.1.454.CMB.1.raw
  modified_base (253)..(256): a, c, t, g, unknown or other
  misc_feature (253)..(256): n is a, c, g, or t

SEQ ID NO: 173978 - DNA, 256 bp, Homo sapiens
  misc_feature: GYAE6OF02JCQHJ.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnn

SEQ ID NO: 173979 - DNA, 260 bp, Homo sapiens; identical to SEQ ID NO: 173530
  misc_feature: GYAE6OF02H8MNZ.49.65.F10.1.454.CMB.1.raw
  modified_base (254)..(260): a, c, t, g, unknown or other
  misc_feature (254)..(260): n is a, c, g, or t

SEQ ID NO: 173980 - DNA, 253 bp, Homo sapiens
  misc_feature: GYAE6OF02FWS7M.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagn

SEQ ID NO: 173981 - DNA, 254 bp, Homo sapiens
  misc_feature: GYAE6OF02FPNKQ.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctcctctcgactctgagcgggctggcaaggcgcatagnn

SEQ ID NO: 173982 - DNA, 253 bp, Homo sapiens; identical to SEQ ID NO: 173980
  misc_feature: GYAE6OF02G5SZA.49.65.F10.1.454.CMB.1.raw
  modified_base (253)..(253): a, c, t, g, unknown or other
  misc_feature (253)..(253): n is a, c, g, or t

SEQ ID NO: 173983 - DNA, 253 bp, Homo sapiens
  misc_feature: GYAE6OF02GJJQS.49.65.F10.1.454.CMB.1.raw
  modified_base (253)..(253): a, c, t, g, unknown or other
  misc_feature (253)..(253): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctgactctgagcgggctggcaaggcgcatagn

SEQ ID NO: 173984 - DNA, 257 bp, Homo sapiens; identical to SEQ ID NO: 173609
  misc_feature: GYAE6OF02HKWEU.49.65.F10.1.454.CMB.1.raw
  modified_base (254)..(257): a, c, t, g, unknown or other
  misc_feature (254)..(257): n is a, c, g, or t

SEQ ID NO: 173985 - DNA, 266 bp, Homo sapiens
  misc_feature: GYAE6OF02IE6FC.49.65.F10.1.454.CMB.1.raw
  modified_base (256)..(266): a, c, t, g, unknown or other
  misc_feature (256)..(266): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctcgttccccaccctcctctctctcgactctggagcgggctggcaaggcgcatagnnnnnnnnnnn

SEQ ID NO: 173986 - DNA, 254 bp, Homo sapiens; identical to SEQ ID NO: 173463
  misc_feature: GYAE6OF02G7E9Z.49.65.F10.1.454.CMB.1.raw
  modified_base (254)..(254): a, c, t, g, unknown or other
  misc_feature (254)..(254): n is a, c, g, or t

SEQ ID NO: 173987 - DNA, 539 bp, Homo sapiens
  misc_feature: GYAE6OF02JEQVT.49.65.F10.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (536)..(537): a, c, t, g, unknown or other
  misc_feature (536)..(537): n is a, c, g, or t
tcagagtcgagagacacgaccggtgctcgatttagctacgctctaagggacggaccgccaccctgaccactcagccagggtccgaagccggggatgtaggcccgtactaattaacttagtcacgtgttgggaccacgtagtacgtcgagtcgatggtggtggttcggcgaggccaagctgaccgtctaggtcaagcccaagctgccccctggtcactcgtcgttcccgccctcctactcctcctcggactcctgacgacgggaccttggcctaaggccggccagtacgcntgacgcctgagaggcacganacggtctgagtctcngtgcgaagngccaccgngngcgcngngngcgcgtcgtcgtctacgtcggcgacgacgcgcgcgcgctcgcncncgacgacgcgcgtcgtccgtcccgtcgccgcctcctaccacgacgcgtcgcgcggcgcgcgccgcgcgcgtcgtcgcgcgacgtcgtacgtcgtcgtcgtcgtcgcgtcgtacgcggcgtcgacgacgacgcgagcgnncg

SEQ ID NO: 173988 - DNA, 340 bp, Homo sapiens
  misc_feature: GYAE6OF02J4POQ.49.65.F10.1.454.CMB.1.raw
  modified_base (224)..(224): a, c, t, g, unknown or other
  misc_feature (224)..(224): n is a, c, g, or t
  modified_base (283)..(340): a, c, t, g, unknown or other
  misc_feature (283)..(340): n is a, c, g, or t
tcagagtcgagagacacgaccggtgctcgatttagctacgctctaaggggacacggccaccctgaccatcagcagggtcgaagccggggatgaggccactattactgtcacgtgtgggacagtagtagtgatcgtagtggtggtcgtcgggcgacggacagctcgaccgtcgtagccacgccgacggtcctccgtcccctcgtctccgttccgtccttaccccnccctctctccgtcgtacgtcgtcgtggcggtccggtcgacggacgacgggcacgagtcnnnnnnnnnnnnnnnnnnnnnnnnnnnnnnnnnnnnnnnnnnnnnnnnnnnnnnnnnn

SEQ ID NO: 173989 - DNA, 255 bp, Homo sapiens; identical to SEQ ID NO: 173465
  misc_feature: GYAE6OF02GVCZ3.49.65.F10.1.454.CMB.1.raw
  modified_base (254)..(255): a, c, t, g, unknown or other
  misc_feature (254)..(255): n is a, c, g, or t

SEQ ID NO: 173990 - DNA, 255 bp, Homo sapiens; identical to SEQ ID NO: 173604
  misc_feature: GYAE6OF02HSHBO.49.65.F10.1.454.CMB.1.raw
  modified_base (254)..(255): a, c, t, g, unknown or other
  misc_feature (254)..(255): n is a, c, g, or t

SEQ ID NO: 173991 - DNA, 255 bp, Homo sapiens; identical to SEQ ID NO: 173604
  misc_feature: GYAE6OF02IQDQC.49.65.F10.1.454.CMB.1.raw
  modified_base (254)..(255): a, c, t, g, unknown or other
  misc_feature (254)..(255): n is a, c, g, or t

SEQ ID NO: 173992 - DNA, 298 bp, Homo sapiens
  misc_feature: GYAE6OF02IRH9M.49.65.F10.1.454.CMB.1.raw
  modified_base (293)..(298): a, c, t, g, unknown or other
  misc_feature (293)..(298): n is a, c, g, or t
tcagagtcgagagacacgaccggtgctcgatttagctacgctctaagggcacgaccggtgctcgatttagctacgctctaggggacacggccaccctgaccatcagcagggtcgaaggccggggatgaggccgactattactgtcacgtgtgggacagtagtagtgatcatgtggtgttcggcggagggaccaagctgaccgtcctaggtcacgcccaaggctcgcccctcggtcactctcgttccccaccctcctctctctcgactctgagcgggctggcaaggcgcatagnnnnnn

SEQ ID NO: 173993 - DNA, 257 bp, Homo sapiens
  misc_feature: GYAE6OF02FQSO6.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnnnn

SEQ ID NO: 173994 - DNA, 289 bp, Homo sapiens
  misc_feature: GYAE6OF02H6VK7.49.65.F10.1.454.CMB.1.raw
  modified_base (288)..(289): a, c, t, g, unknown or other
  misc_feature (288)..(289): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactatgttcccaccctcctctctctcgactctgagcgggctggcaaggcgcatagnn

SEQ ID NO: 173995 - DNA, 292 bp, Homo sapiens
  misc_feature: GYAE6OF02IW0YR.49.65.F10.1.454.CMB.1.raw
  modified_base (288)..(292): a, c, t, g, unknown or other
  misc_feature (288)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnn

SEQ ID NO: 173996 - DNA, 253 bp, Homo sapiens; identical to SEQ ID NO: 173509
  misc_feature: GYAE6OF02F7YT6.49.65.F10.1.454.CMB.1.raw
  modified_base (253)..(253): a, c, t, g, unknown or other
  misc_feature (253)..(253): n is a, c, g, or t

SEQ ID NO: 173997 - DNA, 259 bp, Homo sapiens
  misc_feature: GYAE6OF02JHK70.49.65.F10.1.454.CMB.1.raw
  modified_base (254)..(259): a, c, t, g, unknown or other
  misc_feature (254)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnn

SEQ ID NO: 173998 - DNA, 254 bp, Homo sapiens
  misc_feature: GYAE6OF02FPJMD.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnn

SEQ ID NO: 173999 - DNA, 277 bp, Homo sapiens
  misc_feature: GYAE6OF02FMYVN.49.65.F10.1.454.CMB.1.raw
  modified_base (257)..(277): a, c, t, g, unknown or other
  misc_feature (257)..(277): n is a, c, g, or t
tcagagtcgagagacacgaccggtgctcgatttagctacgctctaagggacgacgggccaccctgaccatcagcagggtcgaagccggggatgaggccgactattactggtccacgtgtgggacagtaggtagtgatcatgtggtgttcggcggagggaccaagctgaccgtcctaggtcagcccaaggctgccccctggtcactctgttcccgcctcctcctctcgactcgtgagcgggctggcaaggcgcatagnnnnnnnnnnnnnnnnnnnnn

SEQ ID NO: 174000 - DNA, 259 bp, Homo sapiens
  misc_feature: GYAE6OF02GEYLE.49.65.F10.1.454.CMB.1.raw
  modified_base (254)..(259): a, c, t, g, unknown or other
  misc_feature (254)..(259): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnnnn

SEQ ID NO: 174001 - DNA, 255 bp, Homo sapiens; identical to SEQ ID NO: 173465
  misc_feature: GYAE6OF02F90QS.49.65.F10.1.454.CMB.1.raw
  modified_base (254)..(255): a, c, t, g, unknown or other
  misc_feature (254)..(255): n is a, c, g, or t

SEQ ID NO: 174002 - DNA, 254 bp, Homo sapiens
  misc_feature: GYAE6OF02GUHQ3.49.65.F10.1.454.CMB.1.raw
  modified_base (253)..(254): a, c, t, g, unknown or other
  misc_feature (253)..(254): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnn

SEQ ID NO: 174003 - DNA, 298 bp, Homo sapiens
  misc_feature: GYAE6OF02GJ74V.49.65.F10.1.454.CMB.1.raw
  modified_base (288)..(298): a, c, t, g, unknown or other
  misc_feature (288)..(298): n is a, c, g, or t
tcagagtcgagagacacgaccggtgctcgatttagctacgctctaagggcacgaccggtagctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnnnnnnnn

SEQ ID NO: 174004 - DNA, 255 bp, Homo sapiens
  misc_feature: GYAE6OF02F3N9V.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctcgactctgagcgggctggcaaggcgcatagnnn

SEQ ID NO: 174005 - DNA, 256 bp, Homo sapiens
  misc_feature: GYAE6OF02FGLK8.49.65.F10.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnnn

SEQ ID NO: 174006 - DNA, 255 bp, Homo sapiens; identical to SEQ ID NO: 173465
  misc_feature: GYAE6OF02HA8GE.49.65.F10.1.454.CMB.1.raw
  modified_base (254)..(255): a, c, t, g, unknown or other
  misc_feature (254)..(255): n is a, c, g, or t

SEQ ID NO: 174007 - DNA, 253 bp, Homo sapiens; identical to SEQ ID NO: 173980
  misc_feature: GYAE6OF02H7NUF.49.65.F10.1.454.CMB.1.raw
  modified_base (253)..(253): a, c, t, g, unknown or other
  misc_feature (253)..(253): n is a, c, g, or t

SEQ ID NO: 174008 - DNA, 254 bp, Homo sapiens; identical to SEQ ID NO: 173581
  misc_feature: GYAE6OF02GT2FT.49.65.F10.1.454.CMB.1.raw
  modified_base (254)..(254): a, c, t, g, unknown or other
  misc_feature (254)..(254): n is a, c, g, or t

SEQ ID NO: 174009 - DNA, 291 bp, Homo sapiens
  misc_feature: GYAE6OF02G8V3Y.49.65.F10.1.454.CMB.1.raw
  modified_base (288)..(291): a, c, t, g, unknown or other
  misc_feature (288)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccgccctcctctctctcgactctgagcgggctggcaaggcgcatagnnnn

SEQ ID NO: 174010 - DNA, 255 bp, Homo sapiens; identical to SEQ ID NO: 173604
  misc_feature: GYAE6OF02G52N3.49.65.F10.1.454.CMB.1.raw
  modified_base (254)..(255): a, c, t, g, unknown or other
  misc_feature (254)..(255): n is a, c, g, or t

SEQ ID NO: 174011 - DNA, 256 bp, Homo sapiens
  misc_feature: GYAE6OF02HU671.49.65.F10.1.454.CMB.1.raw
  modified_base (254)..(256): a, c, t, g, unknown or other
  misc_feature (254)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcggctggcaaggcgcatagnnn

SEQ ID NO: 174012 - DNA, 254 bp, Homo sapiens; identical to SEQ ID NO: 173463
  misc_feature: GYAE6OF02HMBUV.49.65.F10.1.454.CMB.1.raw
  modified_base (254)..(254): a, c, t, g, unknown or other
  misc_feature (254)..(254): n is a, c, g, or t

SEQ ID NO: 174013 - DNA, 255 bp, Homo sapiens
  misc_feature: GYAE6OF02G65LX.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnn

SEQ ID NO: 174014 - DNA, 257 bp, Homo sapiens
  misc_feature: GYAE6OF02IS7I5.49.65.F10.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgctctaagggacacggccaccctgaccatcagcagggtcgaagccgggatgaggccgactattactgtcacgtgtggacagtagtagtgatcatgtggtgttcggcggagggaccaagctgaccgtcctaggtcagcccaaggctgccccctcggtcactctgttcccgccctcctctctctcgactctgagcggctggcaaggcgcatagnnnnnnn

SEQ ID NO: 174015 - DNA, 255 bp, Homo sapiens
  misc_feature: GYAE6OF02FW784.49.65.F10.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnn

SEQ ID NO: 174016 - DNA, 268 bp, Homo sapiens
  misc_feature: GYAE6OF02I7QAM.49.65.F10.1.454.CMB.1.raw
  modified_base (256)..(268): a, c, t, g, unknown or other
  misc_feature (256)..(268): n is a, c, g, or t
tcagagtcgagagacacgaccggtgctcgatttagctacgctctaaggggacacgggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnnnnnnnnnnn

SEQ ID NO: 174017 - DNA, 335 bp, Homo sapiens
  misc_feature: GYAE6OF02JEOGS.49.65.F10.1.454.CMB.1.raw
  modified_base (269)..(269): a, c, t, g, unknown or other
  misc_feature (269)..(269): n is a, c, g, or t
  modified_base (271)..(273): a, c, t, g, unknown or other
  misc_feature (271)..(273): n is a, c, g, or t
  modified_base (275)..(283): a, c, t, g, unknown or other
  misc_feature (275)..(283): n is a, c, g, or t
  modified_base (285)..(285): a, c, t, g, unknown or other
  misc_feature (285)..(285): n is a, c, g, or t
  modified_base (287)..(335): a, c, t, g, unknown or other
  misc_feature (287)..(335): n is a, c, g, or t
tcagagtcgagagacacgaccggtgctcgatttagctacgctctaaggggacacggccaccctgaccactcagcagggtccgaagcccggggatgaggccgactattactgtcacgtgtgggacagtagtagtgatcagtgtggtgtttcgggtcggagggaccaagcttgaccgtcctaggtcagcccaaggctgccccctggtcactctggttcccgccctccgtctctcgtccgactctgagcgggctggccaaggccgcagtagncnnntnnnnnnnnngngnnnnnnnnnnnnnnnnnnnnnnnnnnnnnnnnnnnnnnnnnnnnnnnnn

SEQ ID NO: 174018 - DNA, 294 bp, Homo sapiens
  misc_feature: GYAE6OF02I0K8L.49.65.F10.1.454.CMB.1.raw
  modified_base (259)..(294): a, c, t, g, unknown or other
  misc_feature (259)..(294): n is a, c, g, or t
tcagagtcgagagacacgaccggtgctcgatttagctacgctctaaggggacacggccgaccctgaccatcagcagggtcgaagccggggatgaggccgacgtattacctgtcacgtcgtggacagtagtagtgatcatgtggtgttcggcgaggaccagctgaccgtctaggtcagcccaaggctgccccctggtcactctgttcccaccctcctctctctccgactctgagcgggctgggccaaggccgacaatagnnnnnnnnnnnnnnnnnnnnnnnnnnnnnnnnnnnn

SEQ ID NO: 174019 - DNA, 255 bp, Homo sapiens; identical to SEQ ID NO: 173465
  misc_feature: GYAE6OF02HDP4O.49.65.F10.1.454.CMB.1.raw
  modified_base (254)..(255): a, c, t, g, unknown or other
  misc_feature (254)..(255): n is a, c, g, or t

SEQ ID NO: 174020 - DNA, 254 bp, Homo sapiens; identical to SEQ ID NO: 174002
  misc_feature: GYAE6OF02FF3QB.49.65.F10.1.454.CMB.1.raw
  modified_base (253)..(254): a, c, t, g, unknown or other
  misc_feature (253)..(254): n is a, c, g, or t

SEQ ID NO: 174021 - DNA, 276 bp, Homo sapiens
  misc_feature: GYAE6OF02FP1GC.49.65.F10.1.454.CMB.1.raw
  modified_base (259)..(276): a, c, t, g, unknown or other
  misc_feature (259)..(276): n is a, c, g, or t
tcagagtcgagagacacgaccggtgctcgatttagctacgctctaagggacacggtccgaccctgaccatcagtcagggtcgaagccggggtaatgaggccgactattactgtcacgtgtgggacagtagtaggtgattcatgtggtgttcgggcggagggaccaagctgaccgtcctaggtcagcccaaggctgccccctcggtcactctgttccacctctctctctcgactctgagcgggctggcaaggcgcatagnnnnnnnnnnnnnnnnnn

SEQ ID NO: 174022 - DNA, 256 bp, Homo sapiens; identical to SEQ ID NO: 173597
  misc_feature: GYAE6OF02GUPDF.49.65.F10.1.454.CMB.1.raw
  modified_base (255)..(256): a, c, t, g, unknown or other
  misc_feature (255)..(256): n is a, c, g, or t

SEQ ID NO: 174023 - DNA, 257 bp, Homo sapiens; identical to SEQ ID NO: 173511
  misc_feature: GYAE6OF02IQ3CS.49.65.F10.1.454.CMB.1.raw
  modified_base (255)..(257): a, c, t, g, unknown or other
  misc_feature (255)..(257): n is a, c, g, or t

SEQ ID NO: 174024 - DNA, 257 bp, Homo sapiens
  misc_feature: GYAE6OF02H4WHU.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctcggtcactctgttcccaccctcctctctctcgactctgagcgggctggcaaggcgcatagnnnnn

SEQ ID NO: 174025 - DNA, 278 bp, Homo sapiens
  misc_feature: GYAE6OF02FGPT6.49.65.F10.1.454.CMB.1.raw
  modified_base (248)..(248): a, c, t, g, unknown or other
  misc_feature (248)..(248): n is a, c, g, or t
  modified_base (254)..(255): a, c, t, g, unknown or other
  misc_feature (254)..(255): n is a, c, g, or t
  modified_base (257)..(278): a, c, t, g, unknown or other
  misc_feature (257)..(278): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttccccaccgtcctctctctcgacctctgagcgggctggcaaggcncatagnnannnnnnnnnnnnnnnnnnnnnn

SEQ ID NO: 174026 - DNA, 291 bp, Homo sapiens
  misc_feature: GYAE6OF02JC3ME.49.65.F10.1.454.CMB.1.raw
  modified_base (286)..(291): a, c, t, g, unknown or other
  misc_feature (286)..(291): n is a, c, g, or t
tcagagtcgagagacacgaccggtgctcgatttagctacgctctaagggcacgaccggtgctcgatttagctacgctctagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnn

SEQ ID NO: 174027 - DNA, 257 bp, Homo sapiens
  misc_feature: GYAE6OF02H7JG2.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctctctctctcgactctgagcgggctggcaaggcgcatagnnnnn

SEQ ID NO: 174028 - DNA, 256 bp, Homo sapiens; identical to SEQ ID NO: 173597
  misc_feature: GYAE6OF02FWKRW.49.65.F10.1.454.CMB.1.raw
  modified_base (255)..(256): a, c, t, g, unknown or other
  misc_feature (255)..(256): n is a, c, g, or t

SEQ ID NO: 174029 - DNA, 292 bp, Homo sapiens
  misc_feature: GYAE6OF02HVD2X.49.65.F10.1.454.CMB.1.raw
  modified_base (286)..(292): a, c, t, g, unknown or other
  misc_feature (286)..(292): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgcccctggtcactctgttccaccctcctctctctcgactctgagcgggctggcaaggcgcatagnnnnnnn

SEQ ID NO: 174030 - DNA, 257 bp, Homo sapiens; identical to SEQ ID NO: 173609
  misc_feature: GYAE6OF02HQ01S.49.65.F10.1.454.CMB.1.raw
  modified_base (254)..(257): a, c, t, g, unknown or other
  misc_feature (254)..(257): n is a, c, g, or t

SEQ ID NO: 174031 - DNA, 271 bp, Homo sapiens
  misc_feature: GYAE6OF02IEJDH.49.65.F10.1.454.CMB.1.raw
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (254)..(271): a, c, t, g, unknown or other
  misc_feature (254)..(271): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctnttctctctcgactctgagcgggctggcaaggcncatagnnnnnnnnnnnnnnnnnn

SEQ ID NO: 174032 - DNA, 256 bp, Homo sapiens
  misc_feature: GYAE6OF02GK23E.49.65.F10.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnn

SEQ ID NO: 174033 - DNA, 255 bp, Homo sapiens
  misc_feature: GYAE6OF02JRMQL.49.65.F10.1.454.CMB.1.raw
  modified_base (250)..(255): a, c, t, g, unknown or other
  misc_feature (250)..(255): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgagcggctggcaaggcgcatagnnnnnn

SEQ ID NO: 174034 - DNA, 490 bp, Homo sapiens
  misc_feature: GYAE6OF02GBB1J.49.65.F10.1.454.CMB.1.raw
  modified_base (276)..(276): a, c, t, g, unknown or other
  misc_feature (276)..(276): n is a, c, g, or t
  modified_base (278)..(279): a, c, t, g, unknown or other
  misc_feature (278)..(279): n is a, c, g, or t
  modified_base (283)..(283): a, c, t, g, unknown or other
  misc_feature (283)..(283): n is a, c, g, or t
  modified_base (290)..(296): a, c, t, g, unknown or other
  misc_feature (290)..(296): n is a, c, g, or t
  modified_base (298)..(298): a, c, t, g, unknown or other
  misc_feature (298)..(298): n is a, c, g, or t
  modified_base (301)..(302): a, c, t, g, unknown or other
  misc_feature (301)..(302): n is a, c, g, or t
  modified_base (304)..(305): a, c, t, g, unknown or other
  misc_feature (304)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (319)..(321): a, c, t, g, unknown or other
  misc_feature (319)..(321): n is a, c, g, or t
  modified_base (323)..(323): a, c, t, g, unknown or other
  misc_feature (323)..(323): n is a, c, g, or t
  modified_base (334)..(335): a, c, t, g, unknown or other
  misc_feature (334)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (342)..(344): a, c, t, g, unknown or other
  misc_feature (342)..(344): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagagtcgagagacacgaccggtgctcgattttagctacgctctaaggggtacgtacgggccaccctgaccatcaggcacgggtcgaacgtccgggggattgaggccgtactatttactgtcacgtgtgggacagtagtagtgatcatgtggtgtttcggcgtagggaccaagcttgacgtctaggtctaagccaaggctgccccctggtcactctgttcccaccctccgtctctcgtcgacttctgagccggggcctggcaaggcgccatagancnngatnacttgannnnnnncngcnngnngngngngngngngnnntntgtgtgtgtgnnananatnnncncngagcgtcncncncncanananactacacacacacntntntncananananacgcagagacgacgacgacgacgacatatattatagtctacgtacgttacttacgttacgttagttacttacttccgtacgtacgtactacg

SEQ ID NO: 174035 - DNA, 258 bp, Homo sapiens
  misc_feature: GYAE6OF02ICPQO.49.65.F10.1.454.CMB.1.raw
  modified_base (255)..(258): a, c, t, g, unknown or other
  misc_feature (255)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnnnn

SEQ ID NO: 174036 - DNA, 314 bp, Homo sapiens
  misc_feature: GYAE6OF02J29GY.49.65.F10.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (284)..(285): a, c, t, g, unknown or other
  misc_feature (284)..(285): n is a, c, g, or t
  modified_base (287)..(287): a, c, t, g, unknown or other
  misc_feature (287)..(287): n is a, c, g, or t
  modified_base (289)..(314): a, c, t, g, unknown or other
  misc_feature (289)..(314): n is a, c, g, or t
tcagagtcgagagacacgaccggtgctcgatttagctacgctctaagggacacggccaccctgaccatcagcaggtcgaagccgggatgaggccgactattactgtcacgtgtggacaggtagtagtgatcatggtggtgttcggcggaggaccaagctgaccgtctaggtcagcccaaggcctcgcccctggtcactcgtcgttccccgcctctctctctcgactcgngacgccgggtctcggactaaggccnctatcgcnnctncngctgntcgntaagccnngncnnnnnnnnnnnnnnnnnnnnnnnnnn

SEQ ID NO: 174037 - DNA, 262 bp, Homo sapiens
  misc_feature: GYAE6OF02I273N.49.65.F10.1.454.CMB.1.raw
  modified_base (250)..(251): a, c, t, g, unknown or other
  misc_feature (250)..(251): n is a, c, g, or t
  modified_base (253)..(262): a, c, t, g, unknown or other
  misc_feature (253)..(262): n is a, c, g, or t
tcagagtcgagagacacgaccggtgctcgatttagctacgctctaagggacacggccaccctgaccatcagcaggtcgaagccgggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcggctggcaaggcgcatagnncnnnnnnnnnn

SEQ ID NO: 174038 - DNA, 256 bp, Homo sapiens; identical to SEQ ID NO: 173466
  misc_feature: GYAE6OF02HNFK4.49.65.F10.1.454.CMB.1.raw
  modified_base (253)..(256): a, c, t, g, unknown or other
  misc_feature (253)..(256): n is a, c, g, or t

SEQ ID NO: 174039 - DNA, 256 bp, Homo sapiens; identical to SEQ ID NO: 173592
  misc_feature: GYAE6OF02HXJDY.49.65.F10.1.454.CMB.1.raw
  modified_base (253)..(256): a, c, t, g, unknown or other
  misc_feature (253)..(256): n is a, c, g, or t

SEQ ID NO: 174040 - DNA, 278 bp, Homo sapiens
  misc_feature: GYAE6OF02H325S.49.65.F10.1.454.CMB.1.raw
  modified_base (259)..(278): a, c, t, g, unknown or other
  misc_feature (259)..(278): n is a, c, g, or t
tcagagtcgagagacacgaccggtgctcgatttagctacgctctaagggacgacggccaccctgaccatccagcagggtcgaagccggggatgaggccgactattactgtcacgttgtgggacagtagtagtgatcatgtggtgttcggcggagggaccaagctgaccgtcctaggtcagcccaaggtctgccccctggtcactctgttccccaccctcctctcctcgactctgagcgggctgggcgaaggcgcatagnnnnnnnnnnnnnnnnnnnn

SEQ ID NO: 174041 - DNA, 258 bp, Homo sapiens
  misc_feature: GYAE6OF02HSGGE.49.65.F10.1.454.CMB.1.raw
  modified_base (254)..(258): a, c, t, g, unknown or other
  misc_feature (254)..(258): n is a, c, g, or t
tcagagtcgagagacacgaccggtgctcgatttagctacgctctaagggacacggccaccctgaccatcagcagggtcgaagccggggatgaggccgactattactgtcacgtgtgggacagtagtagtgatcatgtggtgttcggcggagggaccaagatgaccgtcctaggtcagcccaaggctgccccctcggtcactctgttcccaccctcctctctctcgactctgagcgggctggcaaggcgcatagnnnnn

SEQ ID NO: 174042 - DNA, 256 bp, Homo sapiens; identical to SEQ ID NO: 173592
  misc_feature: GYAE6OF02HC6OS.49.65.F10.1.454.CMB.1.raw
  modified_base (253)..(256): a, c, t, g, unknown or other
  misc_feature (253)..(256): n is a, c, g, or t

SEQ ID NO: 174043 - DNA, 294 bp, Homo sapiens
  misc_feature: GYAE6OF02GZJ8R.49.65.F10.1.454.CMB.1.raw
  modified_base (253)..(294): a, c, t, g, unknown or other
  misc_feature (253)..(294): n is a, c, g, or t
tcagagtcgagagacacgaccggtgctcgatttagctacgctctaagggacacggccaccctgaccatcagcagggtcgaagccggggatgaggccgactatttactgtcacgtgtgggacagtagtagtgatcatgtggtagttcggcggagggaccaagctgaccgtctaggtcagcccaaggctgcccctcggtcactctgttcccacctctctctctcgactctgagtcgggctggcaaggcgcatagnnnnnnnnnnnnnnnnnnnnnnnnnnnnnnnnnnnnnnnnnn

SEQ ID NO: 174044 - DNA, 323 bp, Homo sapiens
  misc_feature: GYAE6OF02FJ558.49.65.F10.1.454.CMB.1.raw
  modified_base (130)..(130): a, c, t, g, unknown or other
  misc_feature (130)..(130): n is a, c, g, or t
  modified_base (286)..(286): a, c, t, g, unknown or other
  misc_feature (286)..(286): n is a, c, g, or t
  modified_base (292)..(323): a, c, t, g, unknown or other
  misc_feature (292)..(323): n is a, c, g, or t
tcagagtcgagagacacgaccggtgctcgattagctacgctctaagggcacgaccggtgctcgattagctacgctctagggacacggccaccctgaccatcagcagggtcgagccgggatgagccgactnttactgtcacgtgtggactagtagtagtgatcatgtgtgtacggcgagaccagctgaccgtcctagcagcccaaggcctcgcccccgtgtcaccttctccgtccccgcctcctctcctccgtacgccttgacgcgccgggtctcgggacacggccncatgcnnnnnnnnnnnnnnnnnnnnnnnnnnnnnnnn

SEQ ID NO: 174045 - DNA, 256 bp, Homo sapiens; identical to SEQ ID NO: 173490
  misc_feature: GYAE6OF02I3XOM.49.65.F10.1.454.CMB.1.raw
  modified_base (254)..(256): a, c, t, g, unknown or other
  misc_feature (254)..(256): n is a, c, g, or t

SEQ ID NO: 174046 - DNA, 256 bp, Homo sapiens
  misc_feature: GYAE6OF02GTT8T.49.65.F10.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgctctaaggggacacggccaccctgaccatcagcagggtcgaagccggggatgaggccgactattactgtcacgtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnn

SEQ ID NO: 174047 - DNA, 265 bp, Homo sapiens
  misc_feature: GYAE6OF02F18O9.49.65.F10.1.454.CMB.1.raw
  modified_base (254)..(265): a, c, t, g, unknown or other
  misc_feature (254)..(265): n is a, c, g, or t
tcagagtcgagagacacgaccggtgctcgatttagctacgctctaagggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnnnnnnnnnn

SEQ ID NO: 174048 - DNA, 257 bp, Homo sapiens
  misc_feature: GYAE6OF02FH9J5.49.65.F10.1.454.CMB.1.raw
  modified_base (254)..(257): a, c, t, g, unknown or other
  misc_feature (254)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccacctcctctctctcgactctgagcgggctggcaaggcgcatagnnnn

SEQ ID NO: 174049 - DNA, 250 bp, Homo sapiens
  misc_feature: GYAE6OF02JTMZ2.49.65.F10.1.454.CMB.1.raw
  modified_base (211)..(211): a, c, t, g, unknown or other
  misc_feature (211)..(211): n is a, c, g, or t
  modified_base (247)..(250): a, c, t, g, unknown or other
  misc_feature (247)..(250): n is a, c, g, or t
tcagagtcgagagacacgaccggtgctcgatttagctacgctctaaggacacggccaccctgaccatcagcaggtcgaagccggatgaggccgactattactgtcacgtgtggacagtagtagtgatcatgtggtgttcggcgagggaccaagctgaccgtcctaggtcagcccaaggctgcccctcggtcactctgttcccacctcctcnctctcgactctgagcggggctggcaaggcgcatagnnnn

SEQ ID NO: 174050 - DNA, 269 bp, Homo sapiens
  misc_feature: GYAE6OF02HD55P.49.65.F10.1.454.CMB.1.raw
  modified_base (260)..(269): a, c, t, g, unknown or other
  misc_feature (260)..(269): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgacggcggctggacgaaggcgctagtagnnnnnnnnnn

SEQ ID NO: 174051 - DNA, 285 bp, Homo sapiens
  misc_feature: GYAE6OF02I2KWJ.49.65.F10.1.454.CMB.1.raw
  modified_base (256)..(256): a, c, t, g, unknown or other
  misc_feature (256)..(256): n is a, c, g, or t
  modified_base (258)..(285): a, c, t, g, unknown or other
  misc_feature (258)..(285): n is a, c, g, or t
tcagagtcgagagacacgaccggtgctcgatttagctacgctctaagggacacggccaccctgaccatcagcagggtcgaagtccggggatgaggccgactattactgtcacgtgtgggacagtagtagtgatcatgtggtgttcggcggtagggaccaagctgtaccgtcctaggtcagcccaaggctgccccctggtcactctgttcccgaccctcctctctctcgactctgagcggctggcaaggcgcatagnannnnnnnnnnnnnnnnnnnnnnnnnnnn

SEQ ID NO: 174052 - DNA, 290 bp, Homo sapiens
  misc_feature: GYAE6OF02IGIES.49.65.F10.1.454.CMB.1.raw
  modified_base (290)..(290): a, c, t, g, unknown or other
  misc_feature (290)..(290): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagn

SEQ ID NO: 174053 - DNA, 326 bp, Homo sapiens
  misc_feature: GYAE6OF02IT8FY.49.65.F10.1.454.CMB.1.raw
  modified_base (292)..(326): a, c, t, g, unknown or other
  misc_feature (292)..(326): n is a, c, g, or t
tcagagtcgagagacacgaccggtgctcgatttagctacgctctaagggcacgaccggtggctcgatttagctacgctctaggggacacggccaccctgaccatcagccagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgtcatagnnnnnnnnnnnnnnnnnnnnnnnnnnnnnnnnnnn

SEQ ID NO: 174054 - DNA, 260 bp, Homo sapiens
  misc_feature: GYAE6OF02IYHNK.49.65.F10.1.454.CMB.1.raw
  modified_base (255)..(260): a, c, t, g, unknown or other
  misc_feature (255)..(260): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttcccgccctcctctctctcgactctgagcgggctggcaaggcgcatagnnnnnn

SEQ ID NO: 174055 - DNA, 255 bp, Homo sapiens
  misc_feature: GYAE6OF02I17T2.49.65.F10.1.454.CMB.1.raw
  modified_base (254)..(255): a, c, t, g, unknown or other
  misc_feature (254)..(255): n is a, c, g, or t
tcagagtcgagagacacgaccggtgctcgatttagctacgctctaagggacacggccaccctgaccatcagcagggtcgaatccggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnn

SEQ ID NO: 174056 - DNA, 255 bp, Homo sapiens; identical to SEQ ID NO: 174013
  misc_feature: GYAE6OF02IY5AE.49.65.F10.1.454.CMB.1.raw
  modified_base (254)..(255): a, c, t, g, unknown or other
  misc_feature (254)..(255): n is a, c, g, or t

SEQ ID NO: 174057 - DNA, 291 bp, Homo sapiens
  misc_feature: GYAE6OF02F5N6R.49.65.F10.1.454.CMB.1.raw
  modified_base (288)..(291): a, c, t, g, unknown or other
  misc_feature (288)..(291): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcatagnnnn

SEQ ID NO: 174058 - DNA, 284 bp, Homo sapiens
  misc_feature: GYAE6OF02FOMF9.49.65.F10.1.454.CMB.1.raw
  modified_base (254)..(284): a, c, t, g, unknown or other
  misc_feature (254)..(284): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgcctcctctctctcgactctgacgcgggctggcaaggcgcatagnnnnnnnnnnnnnnnnnnnnnnnnnnnnnnn

SEQ ID NO: 174059 - DNA, 270 bp, Homo sapiens
  misc_feature: GYAE6OF02G5KND.49.65.F10.1.454.CMB.1.raw
  modified_base (257)..(258): a, c, t, g, unknown or other
  misc_feature (257)..(258): n is a, c, g, or t
  modified_base (260)..(270): a, c, t, g, unknown or other
  misc_feature (260)..(270): n is a, c, g, or t
tcagagtcgagagacacgaccggtgctcgatttagctacgctctaaggggacgacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctgttccccaccctcctctctctcgactctgagcgggctggcaaggcgcatagnngnnnnnnnnnnn

SEQ ID NO: 174060 - DNA, 293 bp, Homo sapiens
  misc_feature: GYAE6OF02HYICM.49.65.F10.1.454.CMB.1.raw
  modified_base (288)..(293): a, c, t, g, unknown or other
  misc_feature (288)..(293): n is a, c, g, or t
tcagagtcgagagacacgaccggtgctcgatttagctacgctctaagggcacgaccggtgctcgatttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccgccctcctctctctcgactctgagcgggctggcaaggcgcatagnnnnnn

SEQ ID NO: 174061 - DNA, 255 bp, Homo sapiens; identical to SEQ ID NO: 173485
  misc_feature: GYAE6OF02H4UHF.49.65.F10.1.454.CMB.1.raw
  modified_base (253)..(255): a, c, t, g, unknown or other
  misc_feature (253)..(255): n is a, c, g, or t

SEQ ID NO: 174062 - DNA, 255 bp, Homo sapiens; identical to SEQ ID NO: 173485
  misc_feature: GYAE6OF02GUJXC.49.65.F10.1.454.CMB.1.raw
  modified_base (253)..(255): a, c, t, g, unknown or other
  misc_feature (253)..(255): n is a, c, g, or t

SEQ ID NO: 174063 - DNA, 256 bp, Homo sapiens; identical to SEQ ID NO: 173490
  misc_feature: GYAE6OF02F7RV0.49.65.F10.1.454.CMB.1.raw
  modified_base (254)..(256): a, c, t, g, unknown or other
  misc_feature (254)..(256): n is a, c, g, or t

SEQ ID NO: 174064 - DNA, 255 bp, Homo sapiens; identical to SEQ ID NO: 173465
  misc_feature: GYAE6OF02FJR7K.49.65.F10.1.454.CMB.1.raw
  modified_base (254)..(255): a, c, t, g, unknown or other
  misc_feature (254)..(255): n is a, c, g, or t

SEQ ID NO: 174065 - DNA, 254 bp, Homo sapiens; identical to SEQ ID NO: 173581
  misc_feature: GYAE6OF02GMVSR.49.65.F10.1.454.CMB.1.raw
  modified_base (254)..(254): a, c, t, g, unknown or other
  misc_feature (254)..(254): n is a, c, g, or t

SEQ ID NO: 174066 - DNA, 261 bp, Homo sapiens
  misc_feature: GYAE6OF02H6GY8.49.65.F10.1.454.CMB.1.raw
  modified_base (250)..(261): a, c, t, g, unknown or other
  misc_feature (250)..(261): n is a, c, g, or t
tcagagtcgagagacacgaccggtgctcgatttagctacgctctaaggacacggccaccctgaccatcagcaggtcgaagccgggatgaggccgactattactgtcacgtgtggacagtagtagtgatcatgtggtgttcggcggagggaccaagctgaccgtcctaggtcagcccaaggccaaccccactgtcactctgttcccaccctcctctctctcgactctgagcggctggcaaggcgcatacgnnnnnnnnnnnn

SEQ ID NO: 174067 - DNA, 257 bp, Homo sapiens
  misc_feature: GYAE6OF02F942C.49.65.F10.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgctctaaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccacctcctctctctcgactctgagcgggctggcaaggcgcatagnnnnn

SEQ ID NO: 174068 - DNA, 264 bp, Homo sapiens
  misc_feature: GYAE6OF02I3D6Z.49.65.F10.1.454.CMB.1.raw
  modified_base (249)..(250): a, c, t, g, unknown or other
  misc_feature (249)..(250): n is a, c, g, or t
  modified_base (255)..(255): a, c, t, g, unknown or other
  misc_feature (255)..(255): n is a, c, g, or t
  modified_base (257)..(264): a, c, t, g, unknown or other
  misc_feature (257)..(264): n is a, c, g, or t
tcagagtcgagagacacgaccggtgctcgatttagctacgctctaagggacacggccaccctgaccatcagcagggtcgaagccgggatgaggccgactattactgtcacgtgtgggacagtagtagtgatcatgtggtgttcggcggagggaccaagctgaccgtcctaggtcagcccaaggctgcccctggtcactctgttcccgcctcctctctctcgactctgacgcggctggcaaggcgcatgnnatgcntnnnnnnnn
